(12) United States Patent
Pollock et al.

(10) Patent No.: US 7,569,662 B2
(45) Date of Patent: Aug. 4, 2009

(54) NUCLEOTIDE AND AMINO ACID SEQUENCES, AND ASSAYS AND METHODS OF USE THEREOF FOR DIAGNOSIS OF LUNG CANCER

(75) Inventors: Sarah Pollock, Tel-Aviv (IL); Zurit Levine, Herzlia (IL); Amit Novik, Beit-HaSharon (IL); Dvir Dahary, Tel-Aviv (IL); Rotem Sorek, Rechovot (IL); Amir Toporik, Azur (IL); Shirley Sameah-Greenwald, Kfar-Saba (IL); Osnat Sella-Tavor, Kfar Kish (IL); Alexander Diber, Richon-LeZion (IL); Gad S. Cojocaru, Ramat-HaSharon (IL); Michal Ayalon-Soffer, Ramat-HaSharon (IL); Shira Walach, Hod-HaSharon (IL); Pinchas Akiva, Ramat-Gan (IL); Naomi Keren, Givat Shmuel (IL); Ronen Shemesh, Modiln (IL)

(73) Assignee: Compugen Ltd, Tel Aviv (IL)

( * ) Notice: Subject to any disclaimer, the term of this patent is extended or adjusted under 35 U.S.C. 154(b) by 268 days.

(21) Appl. No.: 11/051,720

(22) Filed: Jan. 27, 2005

(65) Prior Publication Data
US 2006/0046257 A1    Mar. 2, 2006

Related U.S. Application Data

(60) Provisional application No. 60/620,916, filed on Oct. 22, 2004, provisional application No. 60/628,123, filed on Nov. 17, 2004, provisional application No. 60/621,131, filed on Oct. 25, 2004, provisional application No. 60/620,917, filed on Oct. 22, 2004, provisional application No. 60/628,101, filed on Nov. 17, 2004, provisional application No. 60/620,874, filed on Oct. 22, 2004, provisional application No. 60/628,134, filed on Nov. 17, 2004, provisional application No. 60/620,924, filed on Oct. 22, 2004, provisional application No. 60/628,111, filed on Nov. 17, 2004, provisional application No. 60/620,853, filed on Oct. 22, 2004, provisional application No. 60/628,112, filed on Nov. 17, 2004, provisional application No. 60/620,974, filed on Oct. 22, 2004, provisional application No. 60/628,145, filed on Nov. 17, 2004, provisional application No. 60/620,656, filed on Oct. 22, 2004, provisional application No. 60/628,251, filed on Nov. 17, 2004, provisional application No. 60/620,975, filed on Oct. 22, 2004, provisional application No. 60/628,178, filed on Nov. 17, 2004, provisional application No. 60/620,918, filed on Oct. 22, 2004, provisional application No. 60/628,156, filed on Nov. 17, 2004, provisional application No. 60/620,868, filed on Oct. 22, 2004, provisional application No. 60/628,189, filed on Nov. 17, 2004, provisional application No. 60/621,053, filed on Oct. 25, 2004, provisional application No. 60/620,677, filed on Oct. 22, 2004, provisional application No. 60/628,167, filed on Nov. 17, 2004, provisional application No. 60/621,004, filed on Oct. 22, 2004, provisional application No. 60/539,129, filed on Jan. 27, 2004, provisional application No. 60/539,128, filed on Jan. 27, 2004, provisional application No. 60/634,075, filed on Dec. 8, 2004.

(51) Int. Cl.
*A61K 38/00* (2006.01)

(52) U.S. Cl. .................................... 530/324; 530/350

(58) Field of Classification Search ...................... None
See application file for complete search history.

(56) References Cited

U.S. PATENT DOCUMENTS

| | | | |
|---|---|---|---|
| 5,236,844 A * | 8/1993 | Basset et al. ............. | 435/320.1 |
| 6,613,515 B1 | 9/2003 | Xu et al. | |
| 6,625,545 B1 | 9/2003 | Amitai et al. | |
| 6,720,146 B2 | 4/2004 | Stolk et al. | |
| 6,812,339 B1 | 11/2004 | Venter et al. | |
| 2004/0005579 A1 | 1/2004 | Birse et al. | |
| 2004/0101876 A1 | 5/2004 | Mintz et al. | |
| 2005/0255114 A1 | 11/2005 | Labat et al. | |
| 2006/0040278 A1 | 2/2006 | Cojocaru et al. | |
| 2006/0172311 A1 | 8/2006 | Cohen et al. | |

FOREIGN PATENT DOCUMENTS

WO    03/105758    12/2003

OTHER PUBLICATIONS

Skolnick et al. (Trends in Biotech., 18(1):34-39, 2000).*
Burgess et al, Journal of Cell Biology vol. 111 Nov. 1990 2129-2138.*
Lazar et al Molecular and Cellular Biology Mar. 1988 vol. 8 No. 3 1247-1252.*
Tockman et al (Cancer Res., 1992, 52:2711s-2718s).*
Einat Hazkani-Covo, Erez Levanon, Galit Rotman, Dan Graur and Amit Novik; (2004) "Evolution of multicellularity in metazoa: comparative analysis of the subcellular localization of proteins in Saccharomyces, Drosophila and Caenorhabditis." Cell Biology International 2204;28(3):171-8.
Nucleic Acids Research, 2002, vol. 30, No. 1 207-210.
Su et al (Proc Natl Acad Sci U S A. Apr. 20, 2004;101(16):6062-7. Epub Apr. 9, 2004).
Boguski et al, Nat Genet. Aug. 1993;4(4):332-3.

(Continued)

*Primary Examiner*—Larry R. Helms
*Assistant Examiner*—Meera Natarajan
(74) *Attorney, Agent, or Firm*—Ivor R. Elrifi; David E. Johnson; Mintz, Levin, Cohn, Ferris, Glovsky and Popeo PC

(57) ABSTRACT

Novel markers for lung cancer that are both sensitive and accurate. These markers are overexpressed in lung cancer specifically, as opposed to normal lung tissue. The measurement of these markers, alone or in combination, in patient samples provides information that the diagnostician can correlate with a probable diagnosis of lung cancer. The markers of the present invention, alone or in combination, show a high degree of differential detection between lung cancer and non-cancerous states.

3 Claims, 77 Drawing Sheets

OTHER PUBLICATIONS

Sorek, R., Ast, G. & Graur, D. Alu-containing exons are alternatively spliced. Genome Res 12, 1060-7 (2002).
(1993) K. Hofmann & W. Stoffel. Biol. Chem. Hoppe-Seyler 374, 166.
Tanya Barrett et al. Nucleic Acid Research, 2005, vol. 33. pp. D562-D566.
Anders Krogh. Et al, J. Mol. Biol. (2001) 305, 567-580.
Genome Research (2004), 14(10b), 2121-2127.
http://www.cbs.dtu.dk/services/TMHMM/TMHMM2.0b.guide.php Web page last dated Wednesday Oct. 29, 2003 15:39:07 GMT.
http://www.ch.embnet.org/software/TMPRED_form.html.
http://www.cbs.dtu.dk/services/SignalP/background/prediction.php Web page last dated Thursday May 6, 2004 11:22:25 GMT.
www.affymetrix.com/products/arrays/specific/hgu133.affx.
http://www.affymetrix.com/support/technical/datasheets/human_datasheet.pdf.
http://www.affymetrix.com/products/arrays/specific/hgu133av2.affx.
http://www.affymetrix.com/support/technical/datasheets/human_datasheet.pdf.
www.affymetrix.com/products/arrays/specific/hgu133plus.affx.
http://www.affymetrix.com/support/technical/datasheets/human_datasheet.pdf.
www.ncbi.nlm.nih.gov/projects/geo/.
http://www.ncbi.nlm.nih.gov/projects/geo/info/overview.html.
http://www.ncbi.nlm.nih.gov/geo/query/acc.cgi?acc=GSE1133.
www.ncbi.nlm.nih.gov/Genbank/GenbankOverview.html Last Revised: Sep. 20, 2004.
www.ncbi.nlm.nih.gov/dbEST/ Last Revised Jul. 11, 2000.

* cited by examiner

Figure 1: Schematic description of the cancer biomarker selection engine.
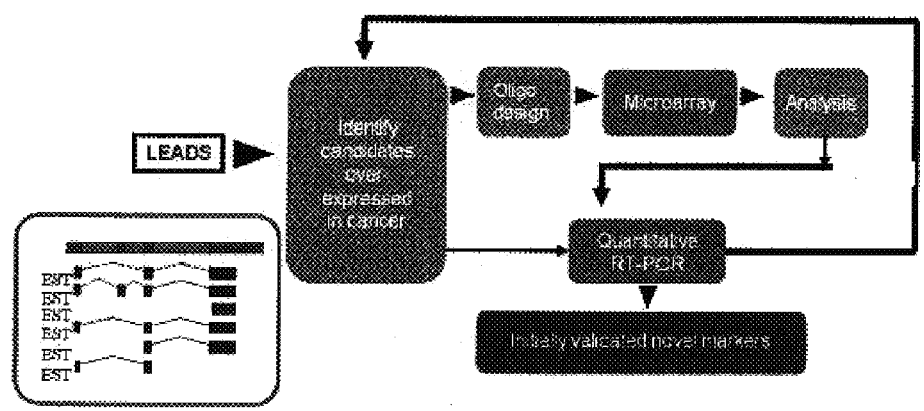
Figure 2: Schematic illustration, depicting grouping of transcripts of a given cluster based on presence or absence of unique sequence regions.
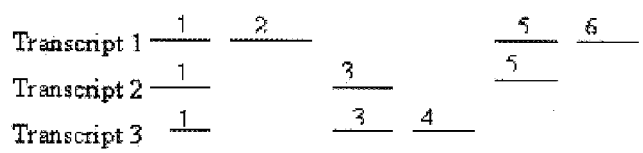

Figure 3: Schematic summary of quantitative real-time PCR analysis.

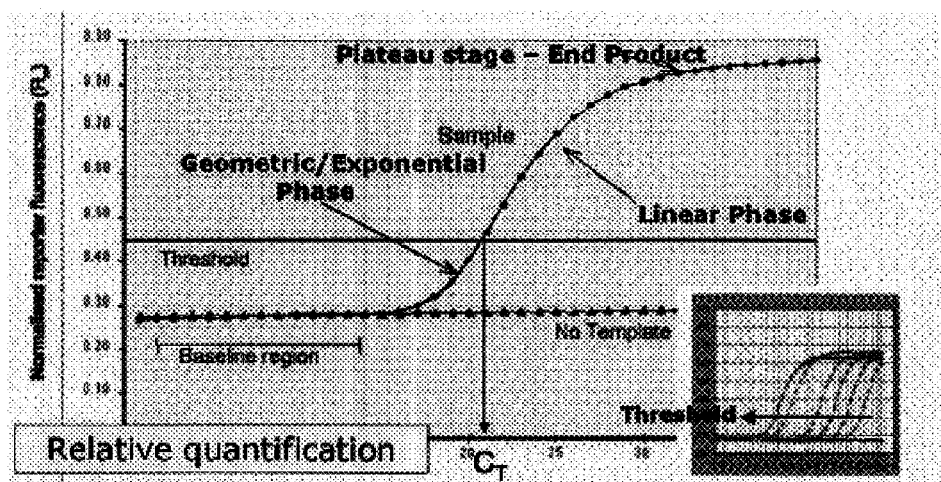

$C_T$ = Threshold Cycle point – A calculated cycle number in which PCR products signal is above the background level (passive dye ROX) and still in the Geometric/Expo phase.

Figure 4: Schematic presentation of the oligonucleotide based microarray fabrication.

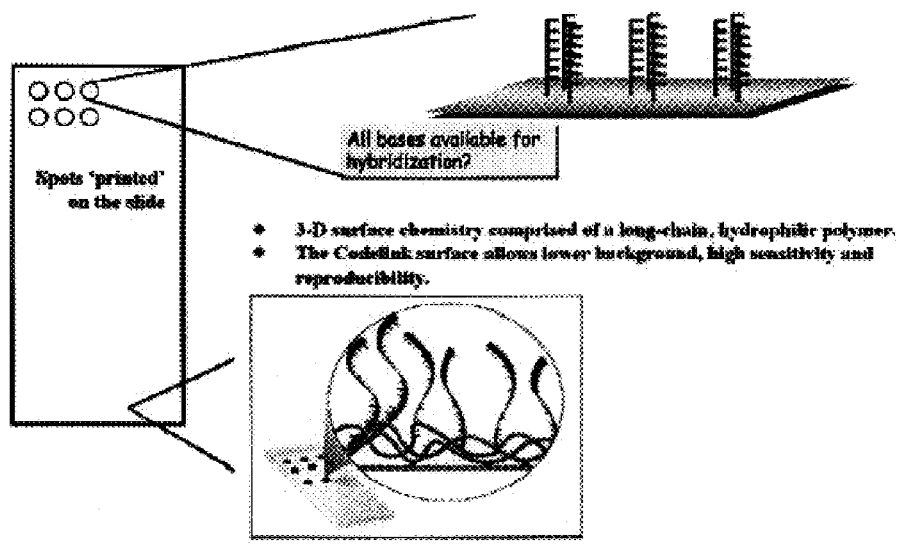

- 3-D surface chemistry comprised of a long-chain, hydrophilic polymer.
- The Codelink surface allows lower background, high sensitivity and reproducibility.

Figure 5: Schematic summary of the oligonucleotide based microarray experimental flow.
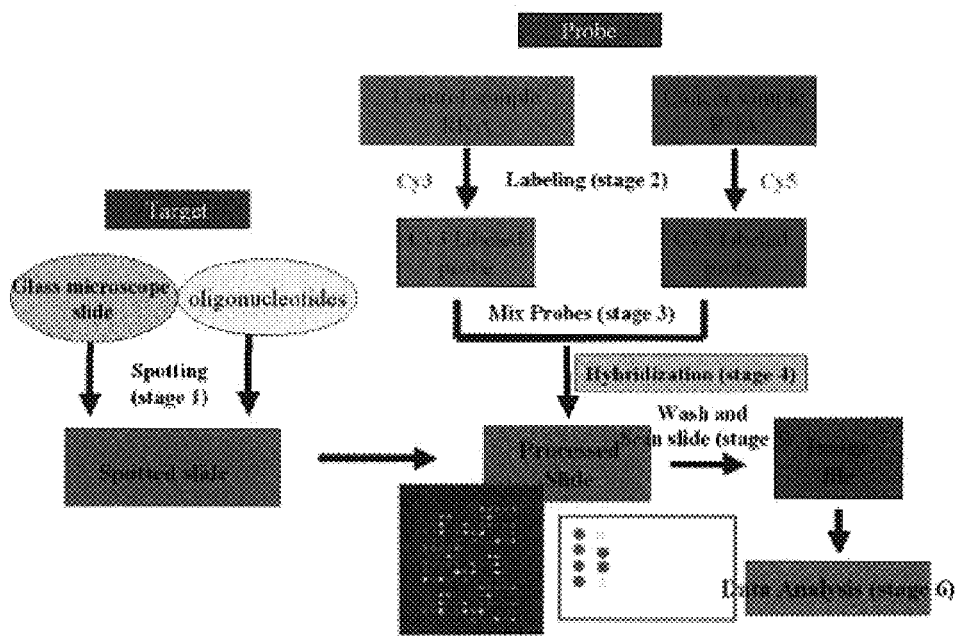
Figure 6:
*Figure 6 - Cancer and cell-line vs. normal tissue expression*
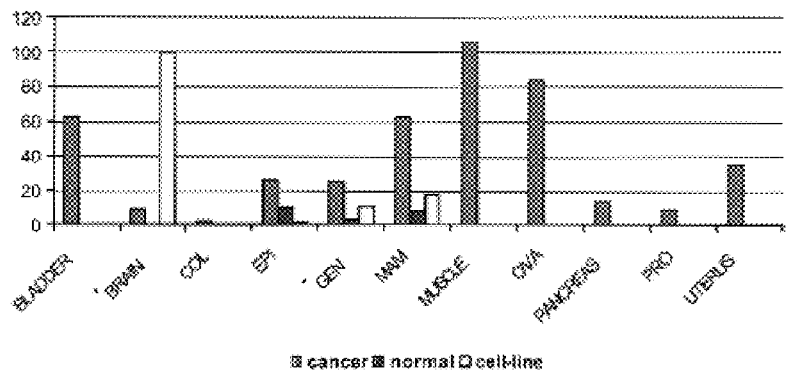

Figure 9 - Cancer and cell-line vs. normal tissue expression

Figure 63a

>gi|47124622|gb|AAH70449.1| ☐ Mapkbp1 protein [Mus musculus]
Length = 1503

```
Score =  911 bits (2354),  Expect = 0.0
Identities = 447/759 (58%), Positives = 576/759 (75%), Gaps = 11/759 (1%)

Query:  40   APPICLRRKTRLSTASEETVQNRVSLEKVLGITAQNSSGLTCDPGTGHVAYLAGCVVVLL    99
             +P I LRR      +   E + ++V+LEKVLG+T       GL CDP +G VAY AGCVVV+
Sbjct:  19   SPSIKLRRSK--AGNREDLSSKVTLEKVLGVTVSGRGLACDPRSGLVAYSAGCVVVLF    76

Query:  100  DPKENKQQHIFNTARKSLSALAFSPDGKYIVTGENGHRPAVRIMDVEEKNQVAEMLGHKY   159
             +P+++KQ HI N++RK+++ALAFSPDGKY+VTGE+GH PAVR+WDV E++QVAE+ HKY
Sbjct:  77   NPRKHKQHHILNSSRKTITALAFSPDGKYLVTGESGHMPAVRVWDVAERSQVAELQEHKY   136

Query:  160  GVACVAFSPNMKHIVSMGYQHDMVLNVWDMKKDIVVASNKVSCRVIALSFSEDSYFVTV    219
             GVACVAFSP+ K+IVS+GYQHDM++NVW WKK+IVVASNKVS RV A+SFSED SYFVT
Sbjct:  137  GVACVAFSPSAKYIVSVGYQHDMIVNVWAWKKNIVVASNKVSSRVTAVSFSEDCSYFVTA   196

Query:  220  GNRHVRFWFLXXXXXXXXXPLVGRSGILGELHNNIFCGVACCGRMAGSTFCVSYSG    279
             GNRH+ +FW+L             PL+GRSG+ LGEL NN+F  VACGRG  A  STFC++ SG
Sbjct:  197  GNRHIKFWNYLDDSKTSKVNATVPLLGRSGLLGELRNNLFTDVACGRGEKADSTFCITSSG   256

Query:  280  LLCQFNEKRVLEKWINLKXXXXXXXXXQELIFCGCTDGIVRIFQAHSLHYLANLPKPHY   339
             LLC+F++R+L+KW+ L+          QE IFCGC DG VR+F      +L+P+H
Sbjct:  257  LLCEFSDRRLLDKWVELRTTVAHICISVTQEYIFCGCADGTVRLFNPSNLHFLSTLPRPHA   316

Query:  340  LGVDVAQGLEPSFLFHRKAEAVYPDTVALTFDPIHQWLSCVYKDHSIYIMDVKDINRVGK   399
             LG D+A    E S LF    A YPDT+ALTFDP +QWLSCVY DHS1Y+WDV+D +VGK
Sbjct:  317  LGTDIASITEASRLFSGGVNARYPDTIALTFDPINQWLSCVYNDHSIYVWDVRDPKKVGK   376

Query:  400  VWSELFHSSYVWNVEVYPEFED-QRACLPSGSFLTCSSDNTIRFWNLDSSP--DSHWQKN   456
             V+S L+HSS VW+VEVYPE +D +ACLP   SF+TCSSDNT+R WN +SS      S  +N
Sbjct:  377  VYSALYHSSCVWSVEVYPEIKDSHQACLPPSSFITCSSDNTIRLWNTESSGVHGSTLHRN   436

Query:  457  IFSNTLLKVYYENDIQHLQDMSHFPDRGSENGTPMDVKAGVRVMQVSPDGQHLASGDRS   516
             I SN L+K++YV+ + Q LD +   P      +G+ MD + G+R + +SP+GQHLASGDR
Sbjct:  437  ILSNDLIKITYVDGNTQALLD-TELPGGDKADGSLMDPRVGLRSVCISPNGQHLASGDRM   495

Query:  517  GNLRIHELHFMDELVKVEAHDAEVLCLEYSKPETGLTLLASASRDRLIHVLNVERKNYNLE   576
             G LRIHEL  + E++KVEAHD E+LCLEYSKP+TGL LLASASRDRLIHVL+  + Y+L+
Sbjct:  496  GTLRIHELQSLSEMLKVEAHDSETILCLEYSKPDTGLKLLASASRDRLIHVLDAGREYSLQ   555

Query:  577  QTLDDHSSSITAIKFAGNR-DIQMISCGADKSIYFRSAQQGSDGLIIFVRTHHVAEKTTLY   635
             QTLD+HSSSITA+KFA +   ++MISCGADKSIYFR+AQ+   +G+ F RTHHV  KTTLY
Sbjct:  556  QTLDEHSSSITAVKFAASDGQVRMISCGADKSIYFRTAQKSGEGVQFTRTHHVVRKTTLY   615

Query:  636  DMDIDITQKYVAVACQDRNVRVYNTVNGKQKKCYKGSQGDEGSLLKVHVDPSGTFLATSC   695
```

Figure 63a continued

```
Sbjct: 616  DMD++ + KY A+ CQDRN+R++N  +GKQMK +KGSQG++G+L+KV  DPSG  ++ATSC
            DMDVEPSWKYTAIGCQDRNIRIFNISSGKQKKLFRGSQGEDGTLIKVQTDPSGIYIATSC  675

Query: 696  SDKSJSVLDFYSGECIAKMFGHSEIITSMKFTYDCHHLIFVSGSCVFIWHLGPEITNCM  755
            SDK+++S+ DF SGEC+A MFGHSEI+T MKE+ DC HLI+VSGDSC+F+W L E+T M
Sbjct: 676  SDKMLSIFDFSSGECVATMFGHSEIVTGMKFSNDCKHLISVSGDSCIPVWRLSSEMTISM  735

Query: 756  KQHLLEIDHRQ----QQQHTNDKKRSGHPRQDTYVSTPS  790
            +Q L E+ RQ     QQ T+ +I SG +   V PS
Sbjct: 736  RQRLAELRQRQRGIKQQGPTSPQRASGCAKQIHAPVVPPS  774
```

Figure 63b

>gi|34856717|ref|XP_342499.1| ☐ similar to JNK-binding protein JNKBP1 [Rattus norvegicus]

Length = 1530

Score = 910 bits (2353), Expect = 0.0
Identities = 467/868 (53%), Positives = 611/868 (70%), Gaps = 29/868 (3%)

```
Query:  40  APPICLRRRTRLSTASEETVQNRVSLEKVLGITAQNSSGLTCDPGTGHVAYLAGCVVVIL  99
            +P I LRR    +   E + ++V+LEKVLG+T    GL CDP +G VAY AGCVVV+
Sbjct:  18  SPSIKLRHSK--AGNREDLSSKVTLEKVLGVTVSGGRGLACQPRSGLVAYPAGCVVVLF  75

Query: 100  DPKENKQQHIFNTARKLSLSALAFSPDGKYIVTGENGHRPAVRIMDVEEKNQVAEMLGHKY  159
            +P+++KQ HI N++RK++ALAFSPDGKY+ VTGE+GH PAVR+WDV E+NQVAE+ HKY
Sbjct:  76  NPRKHKQHHILNSSRKYITALAFSPDGKYLVTGESGHMPAVRVWDVAERNQVAELQEHKY  135

Query: 160  GVACVAFSPNMKHIVSMGYQHDMVLNVWDMKKDIVVASNKVSCRVIALSFSEDSSYFVTV  219
            GVACVAFSP+ K+IVS+GYQHDM++NVW WKK+IVVASNKVS RV A+SFSED SYFVT
Sbjct: 136  GVACVAFSPSAKYIVSVGYQHDMIVNVWAWKKNIVVASNKVSSRVTAVSFSEDCSYFVTA  195

Query: 220  GNRHVREWFLXXXXXXXXXXXXPLVGRSGILGELHHNIFCGVACGRGMAGSTFCVSYSG  279
            GNRH++FW+L              PL+GRSG+LGEL NN+F  VACGRG+ A STFC++ SG
Sbjct: 196  GNRHIIKFWYLDDSKTSKVNATVPLLCRSGLLGELRNNLFTDVACGRGMKADSTFCITSSG  255

Query: 280  LLCQFNEKRVLEKWINLK------XXXXXXXXXXXQELIFCGCTDGIVRIFQAHSLHYLAM  333
            LLC+F+++R+L+KW+ L+           QE IFCGC DG VR+F   +LH+L+
Sbjct: 256  LLCEFSDRRLLDKWELRNTDSFTTTVAHCISVSQEYIFCGCADGIVRLFNPSNLHFLST  315

Query: 334  LPRHIYLGVDVAQGLEPSFLTHKAGAVYPDTVALTEDPIHQWLSCVYKDHSIYIWDVKD  393
            LP+H+ LG D+A   E S L+   A A  YPDT+ALTEDP +QMLSCVY DHSIY+WDV+D
Sbjct: 316  LPRFHALGYDIATITEASRLFSGGANARYPDTIALTEDPANQWLSCVYNDHSIYVWDVRD  375

Query: 394  INRVGKVWSELFHSSYVWNVEVYPEFED-QRACLPSGSFLTCSSDNTIRFWNLDSSP--D  450
            +  VGK+ S L+HSS VW+VEV+PE +D  +ACLP  SF++CSSDN+IR WN +SS
Sbjct: 376  PKKVGKVYSALYHSSCWMSVEVYPEIKDSNQACLPPSSFITCSSDNTIRLWNTESSGVHG  435
```

Figure 63b continued

```
Query: 451 SHWQKNIFSNTLLKVVYVENDIQHLQDMSHFPDRGSENGTPMDVKAGVRMQVSPDGQHL 510
           S  +NI SN L+K++YV+ + Q L D +    P    +G+ MD + G+R + +SP+GQHL
Sbjct: 436 SALHRNILSNDLIKIIYVDGNTQALLD-TELPGGDKADGSLMDPRVGIRSVCISPNGQHL 494

Query: 511 ASGDRSGNLRIHELHFMDELVKVEAHDAEVLCLEYSKPETGLTLLASASRDRLIHVLNVE 570
           ASGD+ G LR+HEL   + EL+KVEAHD+E+LCLEYSKP+TGL LLASASRDRLIIVL+
Sbjct: 495 ASGDRMGTLRVHELQSLSELLKVEAHDSEILCLEYSKPDTGLKLLASASRDRLIHVLDAG 554

Query: 571 KNYNLEQTLDDHSSSITAIKFAGNR-DIQMISCGADKSIYFRSAQQGSDGLHFVRTHHVA 629
           + Y+L+QTLD+HSSSITA+KFA  +   ++MISCCADKSIYFR+AQ+ +G+ F RTHHV
Sbjct: 555 REYSLQQTLDEHSSSITAVKFAASDGQVRMISCGADKSIYFRIAQKSGEGVQFTRTHHVV 614

Query: 630 EKTTLYDMDIDITQKYVAVACQDRNVRVYNTVNGKQKKCYKSQGDEGSLLKVHVDPSGT 689
           KT+LYDMD++ + KY A+ CQDRN+R++N  +GKQKK +KGSQG++G+L+KV  DPSG
Sbjct: 615 RKTTLYDMDVEPSWKYTAIGCQDRNLRLFNLSSGKQKKLFKGSQGEDGTLIKVQTDPSGI 674

Query: 690 FLATSCSCDKSISVIDFYSGECIAKMFGHSEIITSMKFTYDCHHLITVSGDSCVFIWHLGP 749
           ++ATSCSDK++S+ DF+SGEC+A MFGHSEI+T MKF+ DC HLI+VSGDSC+F+W L
Sbjct: 675 YIATSCSDKNLSIFDFFSGECVATMFGHSEIVTGMKFSNDCKHLISVSGDSCIFVWRLSS 734

Query: 750 EITNCMKQHLLEIDHRQ----QQQHTNDKKRSGHPRQDTYVSTPSEIHSLSPGXXXXXXX 805
           E+T M+Q L E+ RQ      QQ T+ +K SG +    V PS   P
Sbjct: 735 EMTISMRQRLAELRQRQRGIKQQGPTSPQKASGAKQHHPPVVPPS----GPALSSDSDK 789

Query: 806 XXXXXXXXMLKTPSKDSLDPDPRCLLTNGKLPL------WAKRLLGDDDVADGSAFHAK 858
                + P+ L  + L +G P      W  ++    G A  A
Sbjct: 790 EGEDEGTEEEELPALPILGKSTKKELASGSSPALLRSLSHWEMSRAQENMEFLGPAPTAN 849

Query: 859 RSYQHGRWAERACGQEPLKTILDAQDLD 886
           + GRWA+ + ++++LD + L+
Sbjct: 850 TGPKRRGRWAQPGVELSVRSMLDLRQLE 877
```

Figure 80
TGCTGTCGCCTCCTCTGATGCGCTTGCCCTCTCCCGGCCCCGGGACTCCGGGAGAATGTGGGTCCTAGGCATCGCG
GCAACTTTTTGCGGATTGTTCTTGCTTCCAGGCTTTGCGCTGCAAATCCAGTGCTACCAGTGTGAAGAATTCCAGCT
GAACAACGACTGCTCCTCCCCCGAGTTCATTGTGAATTGCACGGTGAACGTTCAAGACATGTGTCAGAAAGAAGTG
ATGGAGCAAAGTGCCGACACTAAAAGAACAAACACCTTGCTCTTCGAGATGAGACATTTTGCCAAGCAGTTGACCA
CTTAGTTCTCAAGAAGCAACTATCTCTTTCATGTGCCTTCTGAGG

Figure 83

MRGSHHHHHHGMASMWVLGIAATFCGLFLLPGFALQIQCYQCEEFQLNNDCSSPEFIVNCTVNVQDMCQKEVMEQSADTKRT
NTLLFEMRHFAKQLTT

Figure 84

GATCTCGATCCCGCGAAATTAATACGACTCACTATAGGGAGACCACAAGCGTTTCCCTCTAGAAATAATTTTGTTTAACTTTAAG
AAGGAGATATACATATGCGGGGTTCTCATCATCATCATCATGTATGGCTAGCATGTGGCTCCTAGGCATCGCGG
CAACTTTTTGCCGATTGTTCTTCTTCCAGGCTTTGCCGCTGCAAATCCAGTGCTACCAGTGTGAAGAATTCCAGCTG
AACAACGACTGCTCCTCCCCCGAGTTCATTGTGAATTGCACGGTGAACGTTCAAGACATGTCAGAAGAAGTGA
TGGAGCAAAGTGCCCGACACTAAAGAACAACAAACCTTGCTTCTTCCGAGATGAGACATTTGCCAAGCAGTTGACCAC
TTAGAAGCTTGATCCGGCTGCTAACAAAGCCCGAAAGGAAGCTGAGTTGGCTGCTGCCACCGCTGAGCAATAACTAGCATAACCC
CTTGGGGCCTCTAAACGGGTCTTGAGGGTTTTTTGCTGAAAGGAGAACTATATCCGGATCTGGCGTAATAGGGAAGAGGCCCG
CACCGATCGCCCTTCCCAACAGTTGCGCAGCCTGAATGGCGAATGGGCGCCCCTGTAGCGGCGCATTAAGCGCGGCGGGTGT
GGTGGTTACGCGCAGCGTGACCGCTACACTTGCCAGCGCCCTAGCGCCCGCTCCTTTCGCTTTCTTCCCTTCCTTCTCGCCAC
GTTCGCCGGCTTTCCCCGTCAAGCTCTAAATCGGGGCTCCCTTTAGGGTTCCGATTTAGTGCTTTACGGCACCTCGACCCC
AAAAAACTTGATTAGGGTGATGGTTCACGTAGTGGCCATGGCCCTGATAGACGGTTTTTCGCCCTTTGACGTTGGAGTCC
ACGTTCTTTAATAGTGGACTCTTGTTCCAAACTGAAAATGAGCTGATTTAACAAAAATTTAACGCGAATTTTAATATATTAACGC
TTTTGCCGATTTCGGCCTATTGGTTAAAAAATGGCACTTTTCGGGGAAATGTGCGCGGAACCCCTATTTGTTTATTTTCTAAATACATTCAAATATGTAT
TTACAATTTAGGTGGCACTTTTCGGGGAAATGTGCGCGGAACCCCTATTTGTTTATTTTCTAAATACATTCAAATATGTAT
CCGCTCATGAGACAATAACCCTGATAAATGCTTCAATAATATTGAAAAAGGAAGAGTATGAGTATTCAACATTTCCGTGTC
GCCCTTATTCCCTTTTTGCGGCATTTTGCCTTCCTGTTTTTGCTCACCCAGAAACGCTGGTGAAAGTAAAAGATGCTGAAG
ATCAGTTGGGTGCACGAGTGGGTTACATCGAACTGGATCTCAACAGCGGTAAGATCCTTGAGAGTTTTCGCCCCGAAGAA
CGTTTTCCAATGATGAGCACTTTTAAAGTTCTGCTATGTGGCGCGGTATTATCCCGTATTGACGCCGGGCAAGAGCAACTC
GGTCGCCGCATACACTATTCTCAGAATGACTTGGTTGAGTACTCACCAGTCACAGAAAAGCATCTTACGGATGGCATGACA
GTAAGAGAATTATGCAGTGCTGCCATAACCATGAGTGATAACACTGCGGCCAACTTACTTCTGACAACGATCGGAGGACC
GAAGGAGCTAACCGCTTTTTTGCACAACATGGGGGATCATGTAACTCGCCTTGATCGTTGGGAACCGGAGCTGAATGAAG
CCATACCAAACGACGAGCGTGACACCACGATGCCTGTAGCAATGGCAACAACGTTGCGCAAACTATTAACTGGCGAACTA

Figure 84 continued

CTTACTCTAGCTTCCCGGCAACAATTAATAGACTGGATGGAGGCGGATAAAGTTGCAGGACCACTTCTGGCTCGGCCCTT
CCGGCTGGCTGGTTTATTGCTGATAAATCTGGAGCCGGTGAGCGTCGCGGTATCATTGCAGCACTGGGCCAGAT
GGTAAGCCCTCCCCGTATCGTAGTTATCTACACGACGGGGAGTCAGGCAACTATGGATGAACGAAATAGACAGATCGCTGA
GATAGGTGCCTCACTGATTAAGCATTGGTAGTGTCAGACCAAGTTACTCATATATACTTAGATTGATTAAAACTTCAT
TTTTAATTTAAAAGGATCTAGGTGAAGATCCTTTTGATAATCTCATGACCAAAATCCCTTAACGTGAGTTTTCGTTCCACT
GAGCGTCAGACCCCGTAGAAAAGATCAAAGGATCTTCTTGAGATCCTTTTTTTCTGCGCGTAATCTGCTGCTTGCAAACAA
AAAACCACCGCTACCAGCGGTGGTTTGTTTGCCGGATCAAGAGCTACCAACTCTTTTTCCGAAGGTAACTGGCTTCAGCA
GAGCGCAGATACCAAATACTGTTCTTCTAGTGTAGCCGTAGTTAGGCCACCACTTCAAGAACTCTGTAGCACCGCTACAT
ACCTCGCTCTGCTAATCCTGTTACCAGTGGCTGCTGCCAGTGGCGATAAGTCGTGTCTTACCGGGTTGGACTCAAGACGAT
AGTTACCGGATAAGGCGCAGCGGTCGGGCTGAACGGGGGGTTCGTGCACACAGCCCAGCTTGGAGCGAACGACCTACACC
GAACTGAGATACCTACAGCGTGAGCTATGAGAAAGCGCCACGCTTCCCGAAGGGAGAAAGGCGGACAGGTATCCGGTAA
GCGGCAGGGTCGGAACAGGAGAGCGCACGAGGGAGCTTCCAGGGGGAAACGCCTGGTATCTTTATAGTCCTGTCGGGTTT
CGCCACCTCTGACTTGAGCGTCGATTTTTGTGATGCTCGTCAGGGGGGCGGAGCCTATGGAAAAACGC
CAGCAACGCGGCCTTTTTACGGTTCCTGGCCTTTTGCTGGCCTTTTGCTCACATGTTCTTTCCTGCGTTATCCCCTGATTCTG
TGGATAACCGTATTACCGCCTTTGAGTGAGCTGATACCGCTCGCCGCAGCCGAACGACCGAGCGCAGCGAGTCAGTGAGC
GAGGAAGCGGAAGAGCGCCCAATACGCAAACCGCCTCTCCCCGCGCGTTGGCCGATTCATTAATGCAG

NUCLEOTIDE AND AMINO ACID SEQUENCES, AND ASSAYS AND METHODS OF USE THEREOF FOR DIAGNOSIS OF LUNG CANCER

CROSS-REFERENCE TO RELATED APPLICATION(S)

This application is related to Novel Nucleotide and Amino Acid Sequences, and Assays and Methods of use thereof for Diagnosis of Lung Cancer, and claims priority to the below U.S. provisional applications which are incorporated by reference herein:

Application No. 60/620,916 filed Oct. 22, 2004—Differential Expression of Markers in Colon Cancer Application No. 60/628,123 filed Nov. 17, 2004—Differential Expression of Markers in Colon Cancer II Application No. 60/621,131 filed Oct. 25, 2004—Diagnostic Markers for Colon Cancer, and Assays and Methods of use thereof.

Application No. 60/620,917 filed Oct. 22, 2004—Differential Expression of Markers in Breast Cancer Application No. 60/628,101 filed Nov. 17, 2004—Differential Expression of Markers in Breast Cancer II Application No. 60/620,874 filed Oct. 22, 2004—Differential Expression of Markers in Ovarian Cancer Application No. 60/628,134 filed Nov. 17, 2004—Differential Expression of Markers in Ovarian Cancer II Application No. 60/620,924 filed Oct. 22, 2004—Differential Expression of Markers in Stomach Cancer Application No. 60/628,111 filed Nov. 17, 2004—Differential Expression of Markers in Stomach Cancer II Application No. 60/620,853 filed Oct. 22, 2004—28814—Differential Expression of Markers in Lung Cancer Application No. 60/628,112 filed Nov. 17, 2004—Differential Expression of Markers in Lung Cancer II Application No. 60/620,974 filed Oct. 22, 2004—Differential Expression of Markers in Pancreatic Cancer Application No. 60/628,145 filed Nov. 17, 2004—Differential Expression of Markers in Pancreatic Cancer II Application No. 60/620,656 filed Oct. 22, 2004—Differential Expression of Markers in Prostate Cancer Application No. 60/628,251 filed Nov. 17, 2004—Differential Expression of Markers in Prostate Cancer II Application No. 60/620,975 filed Oct. 22, 2004—Differential Expression of Markers in Brain Cancer Application No. 60/628,178 filed Nov. 17, 2004—Differential Expression of Markers in Brain Cancer II Application No. 60/620,918 filed Oct. 22, 2004—Diagnostic Markers for Renal Cancer, and Assays and Methods of Use thereof.

Application No. 60/628,156 filed Nov. 17, 2004—Diagnostic Markers for Renal Cancer, and Assays and Methods of Use thereof II Application No. 60/620,868 filed Oct. 22, 2004—Differential Expression of Markers in Uterine Cancer Application No. 60/628,189 filed Nov. 17, 2004—Differential Expression of Markers in Uterine Cancer II Application No. 60/621,053 filed Oct. 25, 2004—Variants of CD117, Use as Diagnostic Markers, and Assays and Methods of Use thereof.

Application No. 60/634,075 filed Dec. 8, 2004—Variants of CD117, Use as Diagnostic Markers, and Assays and Methods of Use thereof II Application No. 60/620,677 filed Oct. 22, 2004—Differential Expression of Markers in Bladder Cancer Application No. 60/628,167 filed Nov. 17, 2004—Differential Expression of Markers in Bladder Cancer II Application No. 60/621,004 filed Oct. 22, 2004—Differential Expression of Markers in Skin and Epithelial Cancer II Application No. 60/539,129 filed Jan. 27, 2004—Methods and Systems for Annotating Biomolecular Sequences Application No. 60/539,128 filed Jan. 27, 2004—Evolutionary Conserved Spliced Sequences and Methods and Systems for Identifying thereof

FIELD OF THE INVENTION

The present invention is related to novel nucleotide and protein sequences that are diagnostic markers for lung cancer, and assays and methods of use thereof.

BACKGROUND OF THE INVENTION

Lung cancer is the primary cause of cancer death among both men and women in the U.S., with an estimated 172,000 new cases being reported in 1994. The five-year survival rate among all lung cancer patients, regardless of the stage of disease at diagnosis, is only 13%. This contrasts with a five-year survival rate of 46% among cases detected while the disease is still localized. However, only 16% of lung cancers are discovered before the disease has spread. Lung cancers are broadly classified into small cell or non-small cell lung cancers. Non-small cell lung cancers are further divided into adenocarcinomas, bronchoalveolar-alveolar, squamous cell and large cell carcinomas. Approximately, 75-85 percent of lung cancers are non-small cell cancers and 15-25 percent are small cell cancers of the lung.

Early detection is difficult since clinical symptoms are often not seen until the disease has reached an advanced stage. Currently, diagnosis is aided by the use of chest x-rays, analysis of the type of cells contained in sputum and fiberoptic examination of the bronchial passages. Treatment regimens are determined by the type and stage of the cancer, and include surgery, radiation therapy and/or chemotherapy.

Early detection of primary, metastatic, and recurrent disease can significantly impact the prognosis of individuals suffering from lung cancer. Non-small cell lung cancer diagnosed at an early stage has a significantly better outcome than that diagnosed at more advanced stages. Similarly, early diagnosis of small cell lung cancer potentially has a better prognosis.

Although current radiotherapeutic agents, chemotherapeutic agents and biological toxins are potent cytotoxins, they do not discriminate between normal and malignant cells, producing adverse effects and dose-limiting toxicities. There remains a need for lung cancer specific cancer markers. There remains a need for reagents and kits which can be used to detect the presence of lung cancer markers in samples from patients. There remains a need for methods of screening and diagnosing individuals who have lung cancer and methods of monitoring response to treatment, disease progression and disease recurrence in patients diagnosed with lung cancer. There remains a need for reagents, kits and methods for determining the type of lung cancer that an individual who has lung cancer has. There remains a need for compositions which can specifically target lung cancer cells. There remains a need for imaging agents which can specifically bind to lung cancer cells. There remains a need for improved methods of imaging lung cancer cells. There remains a need for therapeutic agents which can specifically bind to lung cancer cells. There remains a need for improved methods of treating individuals who are suspected of suffering from lung cancer.

SUMMARY OF THE INVENTION

The background art does not teach or suggest markers for lung cancer that are sufficiently sensitive and/or accurate, alone or in combination.

The present invention overcomes these deficiencies of the background art by providing novel markers for lung cancer that are both sensitive and accurate. Furthermore, these markers are able to distinguish between different types of lung cancer, such as small cell or non-small cell lung cancer, and further between non-small cell lung cancer types, such as adenocarcinomas, squamous cell and large cell carcinomas. These markers are overexpressed in lung cancer specifically, as opposed to normal lung tissue. The measurement of these markers, alone or in combination, in patient (biological) samples provides information that the diagnostician can correlate with a probable diagnosis of lung cancer. The markers of the present invention, alone or in combination, show a high degree of differential detection between lung cancer and non-cancerous states.

According to preferred embodiments of the present invention, examples of suitable biological samples which may optionally be used with preferred embodiments of the present invention include but are not limited to blood, serum, plasma, blood cells, urine, sputum, saliva, stool, spinal fluid or CSF, lymph fluid, the external secretions of the skin, respiratory, intestinal, and genitourinary tracts, tears, milk, neuronal tissue, lung tissue, any human organ or tissue, including any tumor or normal tissue, any sample obtained by lavage (for example of the bronchial system or of the breast ductal system), and also samples of in vivo cell culture constituents. In a preferred embodiment, the biological sample comprises lung tissue and/or sputum and/or a serum sample and/or a urine sample and/or any other tissue or liquid sample. The sample can optionally be diluted with a suitable eluant before contacting the sample to an antibody and/or performing any other diagnostic assay.

Information given in the text with regard to cellular localization was determined according to four different software programs: (i) tmhmm (from Center for Biological Sequence Analysis, Technical University of Denmark DTU, dot cbs dot dtu dot dk/services/TMHMM/TMHMM2 dot 0b dot guide dot php) or (ii) tmpred (from EMBnet, maintained by the ISREC Bioinformatics group and the LICR Information Technology Office, Ludwig Institute for Cancer Research, Swiss Institute of Bioinformatics, dot ch dot embnet dot org/software/TMPRED_form dot html) for transmembrane region prediction; (iii) signal_phmm or (iv) signalp_nn (both from Center for Biological Sequence Analysis, Technical University of Denmark DTU, dot cbs dot dtu dot dk/services/SignalP/background/prediction dot php) for signal peptide prediction. The terms "signal_phmm" and "signalp_.mu.nn" refer to two modes of operation for the program SignalP: hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the ProLoc computational platform [Einat Hazkani-Covo, Erez Levanon, Galit Rotman, Dan Graur and Amit Novik; (2004) "Evolution of multicellularity in metazoa: comparative analysis of the subcellular localization of proteins in Saccharomyces, Drosophila and Caenorhabditis." Cell Biology International 2004; 28(3):171-8.], which predicts protein localization based on various parameters including, protein domains (e.g., prediction of trans-membranous regions and localization thereof within the protein), pI, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows. "T-> C", for example, means that the SNP results in a change at the position given in the table from T to C. Similarly, "M-> Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence. SNPs may optionally be used as diagnostic markers according to the present invention, alone or in combination with one or more other SNPs and/or any other diagnostic marker. Preferred embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Information given in the text with regard to the Homology to the known proteins was determined by Smith-Waterman version 5.1.2 using special (non default) parameters as follows:
  model=sw.model
  GAPEXT=0
  GAPOP=100.0
  MATRIX=blosum 100

Information is given with regard to overexpression of a cluster in cancer based on ESTs. A key to the p values with regard to the analysis of such overexpression is as follows:
  library-based statistics: P-value without including the level of expression in cell-lines (P1)
  library based statistics: P-value including the level of expression in cell-lines (P2)
  EST clone statistics: P-value without including the level of expression in cell-lines (SP1)
  EST clone statistics: predicted overexpression ratio without including the level of expression in cell-lines (R3)
  EST clone statistics: P-value including the level of expression in cell-lines (SP2)
  EST clone statistics: predicted overexpression ratio including the level of expression in cell-lines (R4)

Library-based statistics refer to statistics over an entire library, while EST clone statistics refer to expression only for ESTs from a particular tissue or cancer.

Information is given with regard to overexpression of a cluster in cancer based on microarrays. As a microarray reference, in the specific segment paragraphs, the unabbreviated tissue name was used as the reference to the type of chip for which expression was measured. There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. Oligonucleotide microarray results taken from Affymetrix data were from chips available from Affymetrix Inc, Santa Clara, Calif., USA (see for example data regarding the Human Genome U133 (HG-U133) Set at dot affymetrix dot com/products/arrays/specific/hgu133 dot affx; GeneChip Human Genome U133A 2.0 Array at dot affymetrix dot com/products/arrays/specific/hgu133av2 dot affx; and Human Genome U133 Plus 2.0 Array at dot affymetrix dot com/products/arrays/specific/hgu133plus dot affx). The probe names follow the Affymetrix naming convention. The data is available from NCBI Gene Expression Omnibus (see dot ncbi dot nlm dot nih dot gov/projects/geo/ and Edgar et al, Nucleic Acids Research, 2002, Vol. 30, No. 1 207-210). The dataset (including results) is available from dot ncbi dot nlm dot nih dot gov/geo/query/acc dot cgi?acc=GSE1133 for the Series GSE1133 database (published on March 2004); a reference to these results is as follows: Su et al (Proc Natl Acad Sci USA. 2004 Apr. 20; 101(16):6062-7. Epub 2004 Apr. 9). Probes designed by the present inventors are listed below.

(SEQ ID NO: 204)
>H61775_0_11_0
CCCCAGCTTTTATAGAGCGGCCCAAGGAAGAATATTTCCAAGAAGTAGGG (SEQ ID NO: 205)
>M85491_0_0_25999
GACATCTTTGCATATCATGTCAGAGCTATAACATCATTGTGGAGAAGCTC (SEQ ID NO: 206)
>M85491_0_14_0
GTCATGAAAATCAACACCGAGGTGCGGAGCTTCGGACCTGTGTCCCGCAG (SEQ ID NO: 207)
>Z21368_0_0_61857
AGTTCATCCTTCTTCAGTGTGACCAGTAAATTCTTCCCATACTCTTGAAG (SEQ ID NO: 208)
>HUMGRP5E_0_0_16630
GCTGATATGGAAGTTGGGGAATCTGAATTGCCAGAGAATCTTGGGAAGAG (SEQ ID NO: 209)
>HUMGRP5E_0_2_0
TCTCATAGAAGCAAAGGAGAACAGAAACCACCAGCCACCTCAACCCAAGG (SEQ ID NO: 210)
>D56406_0_5_0
TCTGACTTTTACGGACTTGGCTTGTTAGAAGGCTGAAAGATGATGGCAGG (SEQ ID NO: 211)
>F05068_0_0_5744
ACGGGAGGGAAGGAAGGTGTGCGGGAGGAGTTCTCTGTCTCCACTCCCCT (SEQ ID NO: 212)
>F05068_0_0_5754
CAAGGGGAACTGACCGTTGGTCCCGAAGGTCTAGAAGTGAATGGGAGCAG

-continued
(SEQ ID NO: 213)
>F05068_0_8_0
CTGGGCTTGGACTTCGGAGTTTTGCCATTGCCAGTGGGACGTCTGAGACT (SEQ ID NO: 214)
>F05068_0_1_5751
TCTTAGCAGGTAGGTGCCGCAGACCCTGCGGGTTAAGAGGTGGGTGGGG (SEQ ID NO: 215)
>H38804_0_3_0
CGTAATTGCAGTGCATTTAGACAGGCATCTATTTGGACCTGTTTCTATCT

>HSENA78_0_1_0
TGAAGAGTGTGAGGAAAACCTATGTTTGCCGCTTAAGCTTTCAGCTCAGC (SEQ ID NO: 216)
>R00299_0_8_0

(SEQ ID NO: 217)
CCAAGGCTCGTCTGCGCACCTTGTGTCTTGTAGGGTATGGTATGTGGGAC (SEQ ID NO: 218)
>Z44808_0_8_0
AAAAGCATGAGTTTCTGACCAGCGTTCTGGACGCGCTGTCCACGGACATG (SEQ ID NO: 219)
>Z44808_0_0_72347
ATGTTCTTAGGAGGCAAGCCAGGAGAAGCCGGGTCTGACTTTTCAGCTCA (SEQ ID NO: 220)
>Z44808_0_0_72349
TCCTCCAGACCCAAAGCCACAACCCATCGCAAGTCAAGAACACTTTCCAG (SEQ ID NO: 221)
>AA161187_0_0_433
ACCCTGGGTGGGCAAAAACGTGCTTTCCCGGACGGGGTTGAAGGGGAGAA (SEQ ID NO: 222)
>AA161187_0_0_430
TGGAGACTGTTGCCCCACTCTGCAGATGCAGAAACGGAGGCTTGGCTGCT (SEQ ID NO: 223)
>R66178_0_7_0
CCAGTGTGGTATCCTGGGAAACTCGGTTAAAAGGTGAGGCAGAGTACCAG (SEQ ID NO: 224)
>HUMPHOSLIP_0_0_18458
AAGGAAGCAGGACCAGTGGATGTGAGGCGTGGTCGAAGAACAACAGAAAG (SEQ ID NO: 225)
>HUMPHOSLIP_0_0_18487
ACAGGGGCCAGATGGTGACCCATGACCCAGCCTAAAAGGCAGCCAGAGGG (SEQ ID NO: 226)
>AI076020_0_3_0
ATCAGCACTGCCACCTACACCACGGTGCCGCGCGTGGCCTTCTACGCCGG (SEQ ID NO: 227)
>T23580_0_0_902
GTGAAACCCCATTGGCTTCATTGGCTCCTTGATTTAAACCACGCCCGGCT (SEQ ID NO: 228)
>T23580_0_0_901
TGAGTCCGTGTTATATCATCTGGTCTCATTGATAGGCGGGATAGGGAGGG (SEQ ID NO: 229)
>M79217_0_9_0
TTTGTGGAATAGCAACCCATGGTTATGGCGAGTGACCCGACGTGATCTGG (SEQ ID NO: 230)
>M62096_0_0_20588
AAGGCTTAGGTGCAAAGCCATTGGATACCATACCTGAGACCACACAGCCA (SEQ ID NO: 231)
>M62096_0_7_0
ACCAGAAGCAGCTGTCCAGACTCCGAGACGAAATTGAGGAGAAGCAGAAA (SEQ ID NO: 232)
>M78076_0_7_0
GAGAAGATGAACCCGCTGGAACAGTATGAGCGAAAGGTGAATGCGTCTGT

-continued (SEQ ID NO: 233)
>T99080_0_0_58896
AACTCACAGCAAGAGCTGTGTTCCAGTTAGCTTTGCTACCAGTTATGCAG (SEQ ID NO: 234)
>T08446_0_9_0
CATTTCCACTACGAGAACGTTGACTTTGGCCACATTCAGCTCCTGCTGTC (SEQ ID NO: 235)
>HUMCA1XIA_0_0_14909
GCTGCAATCTAAGTTTCGGAATACTTATACCACTCCAGAAATAATCCTCG (SEQ ID NO: 236)
>HUMCA1XIA_0_18_0
TTCAGAACTGTTAACATCGCTGACGGGAAGTGGCATCGGGTAGCAATCAG (SEQ ID NO: 237)
>T11628_0_9_0
ACAAGATCCCCGTGAAGTACCTGGAGTTCATCTCGGAATGCATCATCCAG (SEQ ID NO: 238)
>T11628_0_0_45174
TAAACAATCAAAGAGCATGTTGGCCTGGTCCTTTGCTAGGTACTGTAGAG (SEQ ID NO: 239)
>T11628_0_0_45161
TGCCTCGCCACAATGGCACCTGCCCTAAAATAGCTTCCCATGTGAGGGCT (SEQ ID NO: 240)
>HUMCEA_0_0_96
CAAGAGGGGTTTGGCTGAGACTTTAGGATTGTGATTCAGCTTAGAGGGAC (SEQ ID NO: 241)
>HUMCEA_0_0_15183
CCTGGTGGGAGCCCATGAGAAGCGAGTTCTCTGTGCAACGGACTTAGTAA (SEQ ID NO: 242)
>HUMCEA_0_0_15182
GCTCCCTGGAGCATCAGCATCATATTCTGGGGTGGAGTCTATCTGGTTCT (SEQ ID NO: 243)
>HUMCEA_0_0_15168
TCCTGCCTGTCACCTGAAGTTCTAGATCATTCCCTGGACTCCACTCTATC (SEQ ID NO: 244)
>HUMCEA_0_0_15180
TTTAACACAGGATTGGGACAGGATTCAGAGGGACACTGTGGCCCTTCTAC (SEQ ID NO: 245)
>R35137_0_5_0
TATGTGGAGGTGGTGAACATGGACGCTGCAGTGCAGCAGCAGATGCTGAA (SEQ ID NO: 246)
>Z25299_0_3_0
AACTCTGGCACCTTGGGCTGTGGAAGGCTCTGGAAAGTCCTTCAAAGCTG (SEQ ID NO: 247)
>HSSTROL3_0_0_12518
ATGAGAGTAACCTCACCCGTGCACTAGTTTACAGAGCATTCACTGCCCCA (SEQ ID NO: 248)
>HSSTROL3_0_0_12517
CAGAGATGAGAGCCTGGAGCATTGCAGATGCCAGGGACTTCACAAATGAA (SEQ ID NO: 249)
>HSS100PCB_0_0_12280
CTCAAAATGAAACTCCCTCTCGCAGAGCACAATTCCAATTCGCTCTAAAA (SEQ ID NO: 250)
>R20779_0_0_30670
CCGCGTTGCTTCTAGAGGCTGAATGCCTTTCAAATGGAGAAGGCTTCCAT The following list of abbreviations for tissues was used in the TAA histograms. The term "TAA" stands for "Tumor Associated Antigen", and the TAA histograms, given in the text, represent the cancerous tissue expression pattern as predicted by the biomarkers selection engine, as described in detail in examples 1-5 below:

"BONE" for "bone";
"COL" for "colon";
"EPI" for "epithelial";
"GEN" for "general";
"LIVER" for "liver";
"LUN" for "lung";
"LYMPH" for "lymph nodes";
"MARROW" for "bone marrow";
"OVA" for "ovary";
"PANCREAS" for "pancreas";
"PRO" for "prostate";
"STOMACH" for "stomach";
"TCELL" for "T cells";
"THYROID" for "Thyroid";
"MAM" for "breast";
"BRAIN" for "brain";
"UTERUS" for "uterus";
"SKIN" for "skin";
"KIDNEY" for "kidney";
"MUSCLE" for "muscle";
"ADREN" for "adrenal";
"HEAD" for "head and neck";
"BLADDER" for "bladder";

It should be noted that the terms "segment", "seg" and "node" are used interchangeably in reference to nucleic acid sequences of the present invention; they refer to portions of nucleic acid sequences that were shown to have one or more properties as described below. They are also the building blocks that were used to construct complete nucleic acid sequences as described in greater detail below. Optionally and preferably, they are examples of oligonucleotides which are embodiments of the present invention, for example as amplicons, hybridization units and/or from which primers and/or complementary oligonucleotides may optionally be derived, and/or for any other use.

As used herein the phrase "lung cancer" refers to cancers of the lung including small cell lung cancer and non-small cell lung cancer, including but not limited to lung adenocarcinoma, squamous cell carcinoma, and adenocarcinoma.

The term "marker" in the context of the present invention refers to a nucleic acid fragment, a peptide, or a polypeptide, which is differentially present in a sample taken from subjects (patients) having lung cancer (or one of the above indicative conditions) as compared to a comparable sample taken from subjects who do not have lung cancer (or one of the above indicative conditions).

The phrase "differentially present" refers to differences in the quantity of a marker present in a sample taken from patients having lung cancer (or one of the above indicative conditions) as compared to a comparable sample taken from patients who do not have lung cancer (or one of the above indicative conditions). For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker in a subject's sample that is consistent with a diagnosis of lung cancer (or one of the above indicative conditions). A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with lung cancer (or one of the above indicative conditions) or a person without lung cancer (or one of the above indicative conditions). A control amount can be either in absolute amount (e.g., microgram/ml) or a relative amount (e.g., relative intensity of signals).

"Detect" refers to identifying the presence, absence or amount of the object to be detected.

A "label" includes any moiety or item detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxide, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

According to preferred embodiments of the present invention, preferably any of the above nucleic acid and/or amino acid sequences further comprises any sequence having at least about 70%, preferably at least about 80%, more preferably at least about 90%, most preferably at least about 95% homology thereto.

Unless otherwise noted, all experimental data relates to variants of the present invention, named according to the segment being tested (as expression was tested through RT-PCR as described).

All nucleic acid sequences and/or amino acid sequences shown herein as embodiments of the present invention relate to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that oligonucleotide and polynucleotide, or peptide and polypeptide, may optionally be used interchangeably.

According to preferred embodiments of the present invention, there is provided an isolated polynucleotide comprising SEQ ID NOs: 1 and 2.

According to preferred embodiments of the present invention, there is provided an isolated polynucleotide comprising SEQ ID NOs: 1022, 1023, 1024, 1025, 1026 and 1027.

According to preferred embodiments of the present invention, there is provided an isolated polypeptide comprising SEQ ID NOs: 1281 and 1282.

According to preferred embodiments of the present invention, there is provided an isolated polynucleotide comprising SEQ ID NOs: 3 and 4.

According to preferred embodiments of the present invention, there is provided an isolated polynucleotide comprising SEQ ID NOs: 1028, 1029, 1030, 1031, 1032, 1033, 1034, 1035, 1036, 1037 and 1038.

According to preferred embodiments of the present invention, there is provided an isolated polypeptide comprising SEQ ID NOs: 1283 and 1284.

According to preferred embodiments of the present invention, there is provided an isolated polynucleotide comprising SEQ ID NOs: 5, 6, 7 and 8.

According to preferred embodiments of the present invention, there is provided an isolated polynucleotide comprising SEQ ID NOs: 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065 and 1066.

According to preferred embodiments of the present invention, there is provided an isolated polypeptide comprising SEQ ID NOs: 1285, 1286, 1287 and 1288.

According to preferred embodiments of the present invention, there is provided an isolated polynucleotide comprising SEQ ID NOs: 9, 10, 11, 12, 13, 14 and 15.

According to preferred embodiments of the present invention, there is provided an isolated polynucleotide comprising SEQ ID NOs: 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099 and 1100.

According to preferred embodiments of the present invention, there is provided an isolated polypeptide comprising SEQ ID NOs 1289, 1290, 1291, 1292, 1293 and 1294.

According to preferred embodiments of the present invention, there is provided an isolated polynucleotide comprising SEQ ID NOs: 20 and 21.

According to preferred embodiments of the present invention, there is provided an isolated polynucleotide comprising SEQ ID NOs: 1130, 1131, 1132, 1133 and 1134.

According to preferred embodiments of the present invention, there is provided an isolated polypeptide comprising SEQ ID NOs: 1299 and 1300.

According to preferred embodiments of the present invention, there is provided an isolated polynucleotide comprising SEQ ID NOs: 22, 23 and 24.

According to preferred embodiments of the present invention, there is provided an isolated polynucleotide comprising SEQ ID NOs: 1135, 1136, 1137, 1138, 1139, 1140, 1141, 1142, 1143 and 1144.

According to preferred embodiments of the present invention, there is provided an isolated polypeptide comprising SEQ ID NOs 1301, 1302 and 1303.

According to preferred embodiments of the present invention, there is provided an isolated polynucleotide comprising SEQ ID NOs: 25, 26 and 27.

According to preferred embodiments of the present invention, there is provided an isolated polynucleotide comprising SEQ ID NOs: 1145, 1146, 1147, 1148, 1149, 1150, 1151, 1152, 1153, 1154, 1155 and 1156.

According to preferred embodiments of the present invention, there is provided an isolated polypeptide comprising SEQ ID NOs 1304 and 1305.

According to preferred embodiments of the present invention, there is provided an isolated polynucleotide comprising SEQ ID NOs: 28.

According to preferred embodiments of the present invention, there is provided an isolated polynucleotide comprising SEQ ID NOs: 1157, 1158, 1159, 1160, 1161, 1162, 1163, 1164, 1165, 1166, 1167, 1168, 1169, 1170 and 1171.

According to preferred embodiments of the present invention, there is provided an isolated polypeptide comprising SEQ ID NO: 1306.

According to preferred embodiments of the present invention, there is provided an isolated polynucleotide comprising SEQ ID NOs: 29 and 30.

According to preferred embodiments of the present invention, there is provided an isolated polynucleotide comprising SEQ ID NOs: 1172, 1173, 1174, 1175, 1176, 1177, 1178, 1179, 1180, 1181, 1182, 1183, 1184, 1185, 1186, 1187, 1188, 1189, 1190 and 1191.

According to preferred embodiments of the present invention, there is provided an isolated polypeptide comprising SEQ ID NOs 1307 and 1308.

According to preferred embodiments of the present invention, there is provided an isolated polynucleotide comprising SEQ ID NOs: 31.

According to preferred embodiments of the present invention, there is provided an isolated polynucleotide comprising SEQ ID NOs: 1192, 1193, 1194, 1195, 1196, 1197 and 1198.

According to preferred embodiments of the present invention, there is provided an isolated polypeptide comprising SEQ ID NO: 1309.

According to preferred embodiments of the present invention, there is provided an isolated polynucleotide comprising SEQ ID NOs: 32.

According to preferred embodiments of the present invention, there is provided an isolated polynucleotide comprising SEQ ID NOs: 1199, 1200, 1201, 1202, 1203, 1204, 1205, 1206, 1207, 1208, 1209, 1210, 1211, 1212, 1213, 1214 and 1215.

According to preferred embodiments of the present invention, there is provided an isolated polypeptide comprising SEQ ID NO. 1310.

According to preferred embodiments of the present invention, there is provided an isolated polynucleotide comprising SEQ ID NOs: 33.

According to preferred embodiments of the present invention, there is provided an isolated polynucleotide comprising SEQ ID NOs: 1216 and 1217, 1218, 1219, 1220, 1221, 1222, 1223, 1224, 1225, 1226 and 1227.

According to preferred embodiments of the present invention, there is provided an isolated polypeptide comprising SEQ ID NO: 1311.

According to preferred embodiments of the present invention, there is provided an isolated polynucleotide comprising SEQ ID NOs: 34.

According to preferred embodiments of the present invention, there is provided an isolated polynucleotide comprising SEQ ID NOs: 1228, 1229, 1230, 1231, 1232 and 1223.

According to preferred embodiments of the present invention, there is provided an isolated polypeptide comprising SEQ ID NO: 1312.

According to preferred embodiments of the present invention, there is provided an isolated polynucleotide comprising SEQ ID NOs: 35.

According to preferred embodiments of the present invention, there is provided an isolated polynucleotide comprising SEQ ID NOs: 1234, 1235, 1236, 1237, 1238, 1239, 1240, 1241, 1242, 1243, 1244, 1245, 1246, 1247, 1248, 1249, 1250, 1251, 1252, 1253 and 1254.

According to preferred embodiments of the present invention, there is provided an isolated polypeptide comprising SEQ ID NO: 1313.

According to preferred embodiments of the present invention, there is provided an isolated polynucleotide comprising SEQ ID NOs: 36, 37, 38, 39 and 40.

According to preferred embodiments of the present invention, there is provided an isolated polynucleotide comprising SEQ ID NOs: 1255, 1256, 1257, 1258, 1259, 1260, 1261, 1262, 1263, 1264, 1265, 1266, 1267, 1268, 1269, 1270, 1271, 1272, 1273, 1274 and 1275.

According to preferred embodiments of the present invention, there is provided an isolated polypeptide comprising SEQ ID NOs 1314, 1315, 1316 and 1317.

According to preferred embodiments of the present invention, there is provided an isolated polynucleotide comprising SEQ ID NOs: 125, 126, 127, 128, 129 and 130.

According to preferred embodiments of the present invention, there is provided an isolated polynucleotide comprising SEQ ID NOs: 887, 888, 889, 890, 891, 892, 893, 894, 895, 896, 897, 898, 899, 900, 901 and 902.

According to preferred embodiments of the present invention, there is provided an isolated polypeptide comprising SEQ ID NOs: 1394, 1395, 1396, 1397 and 1398.

According to preferred embodiments of the present invention, there is provided an isolated polynucleotide comprising a transcript SEQ ID NOs: 131 and 132.

According to preferred embodiments of the present invention, there is provided an isolated polynucleotide comprising SEQ ID NOs: 903, 904, 905, 906, 907, 907, 908 and 909.

According to preferred embodiments of the present invention, there is provided an isolated polypeptide comprising SEQ ID NOs 1399 and 1400.

According to preferred embodiments of the present invention, there is provided an isolated polynucleotide comprising SEQ ID NOs: 99, 100, 101 and 102.

According to preferred embodiments of the present invention, there is provided an isolated polynucleotide comprising SEQ ID NOs: 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787 and 788.

According to preferred embodiments of the present invention, there is provided an isolated polypeptide comprising SEQ ID NOs 1372, 1373, 1374 and 1375.

According to preferred embodiments of the present invention, there is provided an isolated polynucleotide comprising SEQ ID NOs: 134.

According to preferred embodiments of the present invention, there is provided an isolated polynucleotide comprising SEQ ID NOs: 913, 914, 915, 916, 917, 918, 919, 920, 921, 922, 923, 924, 925, 926, 927, 928, 929, 930, 931, 932, 933, 934, 935 and 936.

According to preferred embodiments of the present invention, there is provided an isolated polypeptide comprising SEQ ID NO: 1402.

According to preferred embodiments of the present invention, there is provided an isolated polynucleotide comprising SEQ ID NO: 133.

According to preferred embodiments of the present invention, there is provided an isolated polynucleotide comprising SEQ ID NOs: 910, 911 and 912.

According to preferred embodiments of the present invention, there is provided an isolated polynucleotide comprising SEQ ID NOs: 141, 142 and 142.

According to preferred embodiments of the present invention, there is provided an isolated polynucleotide comprising SEQ ID NOs: 961, 962, 963, 964, 965, 966, 967, 968, 969, 970, 971, 972, 973, 974, 975, 976, 977, 978, 979, 980, 981, 982, 983, 984, 985, 986, 987, 988, 989 and 990.

According to preferred embodiments of the present invention, there is provided an isolated polypeptide comprising:
Protein Name
HUMOSTRO_PEA_1_PEA_1_P21 (SEQ ID NO:1627)
HUMOSTRO_PEA_1_PEA_1_P25 (SEQ ID NO:1628)
HUMOSTRO_PEA_1_PEA_1_P30 (SEQ ID NO:1629)

According to preferred embodiments of the present invention, there is provided an isolated polynucleotide comprising SEQ ID NOs: 51, 52, 53, 54, 55, 56 and 57.

According to preferred embodiments of the present invention, there is provided an isolated polynucleotide comprising SEQ ID NOs: 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569 and 570.

According to preferred embodiments of the present invention, there is provided an isolated polypeptide comprising SEQ ID NOs 1327, 1328, 1329, 1330, 1331, 1332 and 1333.

According to preferred embodiments of the present invention, there is provided an isolated polynucleotide comprising SEQ ID NOs: 135, 136, 137, 138, 139 and 140.

According to preferred embodiments of the present invention, there is provided an isolated polynucleotide comprising SEQ ID NOs: 937, 938, 939, 940, 941, 942, 943, 944, 945, 946, 947, 948, 949, 950, 951, 952, 953, 954, 955, 956, 957, 958, 959 and 960.

According to preferred embodiments of the present invention, there is provided an isolated polypeptide comprising SEQ ID NOs 1403, 1404, 1405, 1406, 1407 and 1408.

According to preferred embodiments of the present invention, there is provided an isolated polynucleotide comprising SEQ ID NOs: 41, 42, 43, 44, 45, 46 and 47.

According to preferred embodiments of the present invention, there is provided an isolated polynucleotide comprising SEQ ID NOs: 482, 483, 484, 495, 486, 487, 488, 489, 490, 491, 492, 493, 494, 495, 496, 497, 498, 499, 500 and 501.

According to preferred embodiments of the present invention, there is provided an isolated polypeptide comprising SEQ ID NOs: 1318, 1319, 1320, 1321, 1322 and 1323.

According to preferred embodiments of the present invention, there is provided an isolated polynucleotide comprising SEQ ID NOs: 121, 122, 123 and 124.

According to preferred embodiments of the present invention, there is provided an isolated polynucleotide comprising SEQ ID NOs: 876, 877, 878, 879, 880, 881, 882, 883, 884, 885 and 886.

According to preferred embodiments of the present invention, there is provided an isolated polypeptide comprising SEQ ID NOs: 1390, 1391, 1392 and 1393.

According to preferred embodiments of the present invention, there is provided an isolated polynucleotide comprising SEQ ID NOs: 48, 49 and 50.

According to preferred embodiments of the present invention, there is provided an isolated polynucleotide comprising SEQ ID NOs: 502, 503, 504, 505, 506, 507, 508, 509, 510, 511, 512, 513, 514, 515, 516 and 517.

According to preferred embodiments of the present invention, there is provided an isolated polypeptide comprising SEQ ID NOs: 1324, 1325 and 1326.

According to preferred embodiments of the present invention, there is provided an isolated polynucleotide comprising SEQ ID NOs: 1464 and 1465.

According to preferred embodiments of the present invention, there is provided an isolated polynucleotide comprising a SEQ ID NOs: 1276, 1277, 1278, 1279 and 1280.

According to preferred embodiments of the present invention, there is provided an isolated polypeptide comprising SEQ ID NO: 1415.

Protein Name Corresponding Transcript(s)
HSU33147_PEA_1_P5 HSU33147_PEA_1_T1 (SEQ ID NO:1464); HSU33147_PEA_1_T2 (SEQ ID NO:1465)

According to preferred embodiments of the present invention, there is provided an isolated polynucleotide comprising SEQ ID NO: 58.

According to preferred embodiments of the present invention, there is provided an isolated polynucleotide comprising SEQ ID NOs: 571, 572, 573, 574, 575, 576, 577 and 578.

According to preferred embodiments of the present invention, there is provided an isolated polypeptide comprising SEQ ID NO: 1334.

According to preferred embodiments of the present invention, there is provided an isolated polynucleotide comprising SEQ ID NOs: 74, 75, 76, 77, 78, 79, 80, 81 and 82.

According to preferred embodiments of the present invention, there is provided an isolated polynucleotide comprising SEQ ID NOs: 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692 and 693.

According to preferred embodiments of the present invention, there is provided an isolated polypeptide comprising SEQ ID NOs 1350, 1351, 1352, 1353, 1354, 1355, 1356 and 1357.

According to preferred embodiments of the present invention, there is provided an isolated polynucleotide comprising SEQ ID NOs:

Transcript Name
T23580_T10 (SEQ ID NO:1626)

According to preferred embodiments of the present invention, there is provided an isolated polynucleotide comprising SEQ ID NOs: 579, 580, 581, 582 and 583.

According to preferred embodiments of the present invention, there is provided an isolated polypeptide comprising SEQ ID NOs 1335.

According to preferred embodiments of the present invention, there is provided an isolated polynucleotide comprising SEQ ID NOs: 59, 60, 61, 62, 63 and 64.

According to preferred embodiments of the present invention, there is provided an isolated polynucleotide comprising SEQ ID NOs: 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614 and 615.

According to preferred embodiments of the present invention, there is provided an isolated polypeptide comprising SEQ ID NOs: 1336, 1337, 1338, 1339 and 1340.

According to preferred embodiments of the present invention, there is provided an isolated polynucleotide comprising SEQ ID NOs: 65, 66, 67, 68, 69, 70, 71, 72 and 73.

According to preferred embodiments of the present invention, there is provided an isolated polynucleotide comprising SEQ ID NOs: 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658 and 659.

According to preferred embodiments of the present invention, there is provided an isolated polypeptide comprising SEQ ID NOs: 1341, 1342, 1343, 1344, 1345, 1346, 1347, 1348 and 1349.

According to preferred embodiments of the present invention, there is provided an isolated polynucleotide comprising SEQ ID NOs: 83, 84, 85, 86, 87, 88, 89, 90, 91, 92, 93, 94, 95 and 96.

According to preferred embodiments of the present invention, there is provided an isolated polynucleotide comprising SEQ ID NOs: 695, 696, 697, 698, 699, 700, 701, 702, 703, 704 and 705.

According to preferred embodiments of the present invention, there is provided an isolated polypeptide comprising SEQ ID NOs 1358, 1359, 1360, 1361, 1362, 1363, 1364, 1365, 1366, 1367, 1368 and 1369.

According to preferred embodiments of the present invention, there is provided an isolated polynucleotide comprising SEQ ID NOs: 97 and 98.

According to preferred embodiments of the present invention, there is provided an isolated polynucleotide comprising SEQ ID NOs: 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740 and 741.

According to preferred embodiments of the present invention, there is provided an isolated polypeptide comprising SEQ ID NOs: 1370 and 1371.

According to preferred embodiments of the present invention, there is provided an isolated polynucleotide comprising SEQ ID NOs: 103, 104, 105, 106, 107 and 108.

According to preferred embodiments of the present invention, there is provided an isolated polynucleotide comprising SEQ ID NOs: 789, 790, 791, 792, 793, 794, 795, 796, 797, 798, 799, 800, 801, 802, 803, 804, 805, 806, 807, 808, 809, 810, 811, 812 and 813.

According to preferred embodiments of the present invention, there is provided an isolated polypeptide comprising SEQ ID NOs: 1376, 1377, 1378 and 1379.

According to preferred embodiments of the present invention, there is provided an isolated polynucleotide comprising SEQ ID NOs: 114, 115, 116, 117, 118 and 119.

According to preferred embodiments of the present invention, there is provided an isolated polynucleotide comprising SEQ ID NOs: 856, 857, 858, 859, 860, 861, 862, 863, 864, 865, 866, 867, 868, 869, 870, 871, 872, 873, 874 and 875.

According to preferred embodiments of the present invention, there is provided an isolated polypeptide comprising SEQ ID NOs: 1385, 1386, 1387, 1388 and 1389.

According to preferred embodiments of the present invention, there is provided an isolated polynucleotide comprising SEQ ID NOs: 144, 145, 146, 147, 148 and 149.

According to preferred embodiments of the present invention, there is provided an isolated polynucleotide comprising SEQ ID NOs: 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015 and 1016.

According to preferred embodiments of the present invention, there is provided an isolated polypeptide comprising SEQ ID NOs: 1409, 1410, 1411, 1412 and 1413.

According to preferred embodiments of the present invention, there is provided an isolated polynucleotide comprising SEQ ID NO: 150.

According to preferred embodiments of the present invention, there is provided an isolated polynucleotide comprising SEQ ID NOs: 1017, 1018, 1019, 1020 and 1021.

According to preferred embodiments of the present invention, there is provided an isolated polypeptide comprising SEQ ID NO: 1414.

According to preferred embodiments of the present invention, there is provided an isolated polynucleotide comprising SEQ ID NOs: 109, 110, 111, 112 and 113.

According to preferred embodiments of the present invention, there is provided an isolated polynucleotide comprising SEQ ID NOs: 814, 815, 816, 817, 818, 819, 820, 821, 822, 823, 824, 825, 826, 827, 829, 830, 831, 832, 833, 834, 835, 836, 837, 838, 839, 840, 841, 842, 843, 844, 845, 846, 847, 848, 849, 850, 851, 852, 853, 854 and 855.

According to preferred embodiments of the present invention, there is provided an isolated polypeptide comprising SEQ ID NOs 1380, 1381, 1382, 1383 and 1384.

According to preferred embodiments of the present invention, there is provided an isolated chimeric polypeptide encoding for HSSTROL3_P4 (SEQ ID NO:1394), comprising a first amino acid sequence being at least 90% homologous to MAPAAWLRSAAARALLPPMLLLLLQPP-PLLARALPPDVHHLHAERRGPQPWHAALPSS PAPAPATQEAPRPASSLRPPRCGVPDPS-DGLSARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:1455), which also corresponds to amino acids 1-163 of HSSTROL3_P4 (SEQ ID NO:1394), a bridging amino acid H corresponding to amino acid 164 of HSSTROL3_P4 (SEQ ID NO:1394), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQGAQY-WVYDGEKPVLGPAPLTELGLVRFPVHAALVWGPE KNKIYFFRGRDYWRFHPSTRRVD-SPVPRRATDWRGVPSEIDAAFQDADG corresponding to amino acids 165-445 of MM11_HUMAN (SEQ ID NO:1455), which also corresponds to amino acids 165-445 of HSSTROL3_P4 (SEQ ID NO:1394), and a third amino acid sequence being at least 70%, optionally at least 80%, preferably at least 85%, more preferably at least 90% and most preferably at least 95% homologous to a polypeptide having the sequence ALGVRQLVGGGHSSRFSHLVVAGL-PHACHRKSGSSSQVLCPEPSALLSVAG (SEQ ID NO: 251) corresponding to amino acids 446-496 of HSSTROL3_P4 (SEQ ID NO:1394), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P4 (SEQ ID NO:1394), comprising a polypeptide being at least 70%, optionally at least about 80%, preferably at least about 85%, more preferably at least about 90% and most preferably at least about 95% homologous to the sequence ALGVRQLVGGGHSSRFSHLVVAGL-PHACHRKSGSSSQVLCPEPSALLSVAG (SEQ ID NO: 251) in HSSTROL3_P4 (SEQ ID NO:1394).

According to preferred embodiments of the present invention, there is provided an isolated chimeric polypeptide encoding for HSSTROL3_P5 (SEQ ID NO:1395), comprising a first amino acid sequence being at least 90% homologous to MAPAAWLRSAAARALLPPMLLLLLQPP-PLLARALPPDVHHLHAERRGPQPWHAALPSS PAPAPATQEAPRPASSLRPPRCGVPDPS-DGLSARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:1455), which also corresponds to amino acids 1-163 of HSSTROL3_P5 (SEQ ID NO:1395), a bridging amino acid H corresponding to amino acid 164 of HSSTROL3_P5 (SEQ ID NO:1395), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQ corresponding to amino acids 165-358 of MM11_HUMAN (SEQ ID NO:1455), which also corresponds to amino acids 165-358 of HSSTROL3_P5 (SEQ ID NO:1395), and a third amino acid sequence being at least 70%, optionally at least 80%, preferably at least 85%, more preferably at least 90% and most preferably at least 95% homologous to a polypeptide having the sequence ELGF-PSSTGRDESLEHCRCQGLHK (SEQ ID NO: 252) corresponding to amino acids 359-382 of HSSTROL3_P5 (SEQ ID NO:1395), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P5 (SEQ ID NO:1395), comprising a polypeptide being at least 70%, optionally at least about 80%, preferably at least about 85%, more preferably at least about 90% and most preferably at least about 95% homologous to the sequence ELGFPSSTGRDESLEHCRCQGLHK (SEQ ID NO: 252) in HSSTROL3_P5 (SEQ ID NO:1395).

According to preferred embodiments of the present invention, there is provided an isolated chimeric polypeptide encoding for HSSTROL3_P7 (SEQ ID NO:1396), comprising a first amino acid sequence being at least 90% homologous to MAPAAWLRSAAARALLPPMLLLLLQPP-
PLLARALPPDVHHLHAERRGPQPWHAALPSS
PAPAPATQEAPRPASSLRPPRCGVPDPS-
DGLSARNRQKRFVLSGGRWEKTDLTYRILRFP
WQLVQEQVRQTMAEALKVWSDVTPLT-
FTEVHEGRADIMIDFARYW corresponding to amino acids 1-163 of MM11_HUMAN (SEQ ID NO:1455), which also corresponds to amino acids 1-163 of HSSTROL3_P7 (SEQ ID NO:1396), a bridging amino acid H corresponding to amino acid 164 of HSSTROL3_P7 (SEQ ID NO:1396), a second amino acid sequence being at least 90% homologous to GDDLPFDGPGGILAHAFFPKTHREGDVH-
FDYDETWTIGDDQGTDLLQVAAHEFGHVLG LQHT-
TAAKALMSAFYTFRYPLSLSPD-
DCRGVQHLYGQPWPTVTSRTPALGPQAGIDTN
EIAPLEPDAPPDACEASFDAVSTIRGEL-
FFFKAGFVWRLRGGQLQPGYPALASRHWQGL
PSPVDAAFEDAQGHIWFFQG corresponding to amino acids 165-359 of MM11_HUMAN (SEQ ID NO:1455), which also corresponds to amino acids 165-359 of HSSTROL3_P7 (SEQ ID NO:1396), and a third amino acid sequence being at least 70%, optionally at least 80%, preferably at least 85%, more preferably at least 90% and most preferably at least 95% homologous to a polypeptide having the sequence TTGVSTPAPGV (SEQ ID NO: 253) corresponding to amino acids 360-370 of HSSTROL3_P7 (SEQ ID NO:1396), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P7 (SEQ ID NO:1396), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P7 (SEQ ID NO:1396).

According to preferred embodiments of the present invention, there is provided an isolated chimeric polypeptide encoding for HSSTROL3_P8 (SEQ ID NO:1397), comprising a first amino acid sequence being at least 90% homologous to MAPAAWLRSAAARALLPPMLLLLLQPP-
PLLARALPPDVHHLHAERRGPQPWHAALPSS
PAPAPATQEAPRPASSLRPPRCGVPDPS-
DGLSARNRQKRFVLSGGRWEKTDLTYRILRFP
WQLVQEQVRQTMAEALKVWSDVTPLT-
FTEVHEGRADIMIDFARYW corresponding to amino acids 1-163 of MM11_HUMAN (SEQ ID NO:1455), which also corresponds to amino acids 1-163 of HSSTROL3_P8 (SEQ ID NO:1397), a bridging amino acid H corresponding to amino acid 164 of HSSTROL3_P8 (SEQ ID NO:1397), a second amino acid sequence being at least 90% homologous to GDDLPFDGPGGILAHAFFPKTHREGDVH-
FDYDETWTIGDDQGTDLLQVAAHEFGHVLG LQHT-
TAAKALMSAFYTFRYPLSLSPD-
DCRGVQHLYGQPWPTVTSRTPALGPQAGIDTN
EIAPLE corresponding to amino acids 165-286 of MM11_HUMAN (SEQ ID NO:1455), which also corresponds to amino acids 165-286 of HSSTROL3_P8 (SEQ ID NO:1397), and a third amino acid sequence being at least 70%, optionally at least 80%, preferably at least 85%, more preferably at least 90% and most preferably at least 95% homologous to a polypeptide having the sequence VRP-
CLPVPLLLCWPL (SEQ ID NO: 254) corresponding to amino acids 287-301 of HSSTROL3_P8 (SEQ ID NO:1397), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P8 (SEQ ID NO:1397), comprising a polypeptide being at least 70%, optionally at least about 80%, preferably at least about 85%, more preferably at least about 90% and most preferably at least about 95% homologous to the sequence VRPCLPVPLLLCWPL (SEQ ID NO: 254) in HSSTROL3_P8 (SEQ ID NO:1397).

According to preferred embodiments of the present invention, there is provided an isolated chimeric polypeptide encoding for HSSTROL3_P9 (SEQ ID NO:1398), comprising a first amino acid sequence being at least 90% homologous to MAPAAWLRSAAARALLPPMLLLLLQPP-
PLLARALPPDVHHLHAERRGPQPWHAALPSS PAPAP-
ATQEAPRPASSLRPPRCGVPDPSDGLSARNRQK corresponding to amino acids 1-96 of MM11_HUMAN (SEQ ID NO:1455), which also corresponds to amino acids 1-96 of HSSTROL3_P9 (SEQ ID NO:1398), a second amino acid sequence being at least 90% homologous to RILRFP-
WQLVQEQVRQTMAEALKVWSDVTPLT-
FTEVHEGRADIMIDFARYW corresponding to amino acids 113-163 of MM11_HUMAN (SEQ ID NO:1455), which also corresponds to amino acids 97-147 of HSSTROL3_P9 (SEQ ID NO:1398), a bridging amino acid H corresponding to amino acid 148 of HSSTROL3_P9 (SEQ ID NO:1398), a third amino acid sequence being at least 90% homologous to GDDLPFDGPGGILAHAFFPKTHREGD-
VHFDYDETWTIGDDQGTDLLQVAAHEFGHVLG
LQHTTAAKALMSAFYTFRYPLSLSPD-
DCRGVQHLYGQPWPTVTSRTPALGPQAGIDTN EIA-
PLEPDAPPDACEASFDAVSTIRGEL-
FFFKAGFVWRLRGGQLQPGYPALASRHWQGL
PSPVDAAFEDAQGHIWFFQG corresponding to amino acids 165-359 of MM11_HUMAN (SEQ ID NO:1455), which also corresponds to amino acids 149-343 of HSSTROL3_P9 (SEQ ID NO:1398), and a fourth amino acid sequence being at least 70%, optionally at least 80%, preferably at least 85%, more preferably at least 90% and most preferably at least 95% homologous to a polypeptide having the sequence TTGVSTPAPGV (SEQ ID NO: 253) corresponding to amino acids 344-354 of HSSTROL3_P9 (SEQ ID NO:1398), wherein said first amino acid sequence, second amino acid sequence, bridging amino acid, third amino acid sequence and fourth amino acid sequence are contiguous and in a sequential order.

According to preferred embodiments of the present invention, there is provided an isolated chimeric polypeptide encoding for an edge portion of HSSTROL3_P9 (SEQ ID NO:1398), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96−x to 96; and ending at any of amino acid numbers 97+((n−2)−x), in which x varies from 0 to n−2.

According to preferred embodiments of the present invention, there is provided an isolated polypeptide encoding for a tail of HSSTROL3_P9 (SEQ ID NO:1398), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P9 (SEQ ID NO:1398).

According to preferred embodiments of the present invention, there is provided an isolated chimeric polypeptide encoding for HUMCA1XIA_P14 (SEQ ID NO:1372), comprising a first amino acid sequence being at least 90% homologous to MEPWSSRWKTKRWLWDFTVTTLALTFLFQAREVRGAAPVDVLKALDFHNSPEGISKTT GFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTM IVDCKKKTTKPLDRSERAIVDTNGITVFGTRILDEEVFEGDIQQFLITGDPKAAYDYCEH YSPDCDSSAPKAAQAQEPQIDEYAPEDIIEYDYEYGEAEYKEAESVTEGPTVTEETIAQT EANIVDDFQEYNYGTMESYQTEAPRHVSGTNEPNPVEEIFTEEYLTGEDYDSQRKNSED TLYENKEIDGRDSDLLVDGDLGEYDFYEYKEYEDKPTSPPNEEFGPGVPAETDITETSIN GHGAYGEKGQKGEPAVVEPGMLVEGPPGPAGPAGIMGPPGLQGPTGPPGDPGDRGPPG RPGLPGADGLPGPPGTMLMLPFRYGGDGSKGPTISAQEAQAQAILQQARIALRGPPGPM GLTGRPGPVGGPGSSGAKGESGDPGPQGPRGVQGPPGPTGKPGKRGRPGADGGRGMP GEPGAKGDRGFDGLPGLPGDKGHRGERGPQGPPGPPGDDGMRGEDGEIGPRGLPGEAG PRGLLGPRGTPGAPGQPGMAGVDGPPGPKGNMGPQGEPGPPGQQGNPGPQGLPGPQG PIGPPGEKGPQGKPGLAGLPGADGPPGHPGKEGQSGEKGALGPPGPQGPIGYPGPRGVK GADGVRGLKGSKGEKGEDGFPGFKGDMGLKGDRGEVGQIGPRGEDGPEGPKGRAGPT GDPGPSGQAGEKGKLGVPGLPGYPGRQGPKGSTGFPGFPGANGEKGARGVAGKPGPR GQRGPTGPRGSRGARGPTGKPGPKGTSGGDGPPGPPGERGPQGPQGPVGFPGPKGPPGP PGKDGLPGHPGQRGETGFQGKTGPPGPGGVVGPQGPTGETGPIGERGHPGPPGPPGEQG LPGAAGKEGAKGDPGPQGISGKDGPAGLRGFPGERGLPGAQGAPGLKGGEGPQGPPGP V corresponding to amino acids 1-1056 of CA1B_HUMAN_V5 (SEQ ID NO:1447), which also corresponds to amino acids 1-1056 of HUMCA1XIA_P14 (SEQ ID NO:1372), and a second amino acid sequence being at least 70%, optionally at least 80%, preferably at least 85%, more preferably at least 90% and most preferably at least 95% homologous to a polypeptide having the sequence VSMMIINSQTIMVVNYSSSFITLML (SEQ ID NO: 256) corresponding to amino acids 1057-1081 of HUMCA1XIA_P14 (SEQ ID NO:1372), wherein said first amino acid sequence and second amino acid sequence are contiguous and in a sequential order.

According to preferred embodiments of the present invention, there is provided an isolated polypeptide encoding for a tail of HUMCA1XIA_P14 (SEQ ID NO:1372), comprising a polypeptide being at least 70%, optionally at least about 80%, preferably at least about 85%, more preferably at least about 90% and most preferably at least about 95% homologous to the sequence VSMMIINSQTIMVVNYSSSFITLML (SEQ ID NO: 256) in HUMCA1XIA_P14 (SEQ ID NO:1372).

According to preferred embodiments of the present invention, there is provided an isolated chimeric polypeptide encoding for HUMCA1XIA_P15 (SEQ ID NO:1373), comprising a first amino acid sequence being at least 90% homologous to MEPWSSRWKTKRWLWDFTVTTLALTFLFQAREVRGAAPVDVLKALDFHNSPEGISKTT GFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTM IVDCKKKTTKPLDRSERAIVDTNGITVFGTRILDEEVFEGDIQQFLITGDPKAAYDYCEH YSPDCDSSAPKAAQAQEPQIDEYAPEDIIEYDYEYGEAEYKEAESVTEGPTVTEETIAQT EANIVDDFQEYNYGTMESYQTEAPRHVSGTNEPNPVEEIFTEEYLTGEDYDSQRKNSED TLYENKEIDGRDSDLLVDGDLGEYDFYEYKEYEDKPTSPPNEEFGPGVPAETDITETSIN GHGAYGEKGQKGEPAVVEPGMLVEGPPGPAGPAGIMGPPGLQGPTGPPGDPGDRGPPG RPGLPGADGLPGPPGTMLMLPFRYGGDGSKGPTISAQEAQAQAILQQARIALRGPPGPM GLTGRPGPVGGPGSSGAKGESGDPGPQGPRGVQGPPGPTGKPGKRGRPGADGGRGMP GEPGAKGDRGFDGLPGLPGDKGHRGERGPQGPPGPPGDDGMRGEDGEIGPRGLPGEAG PRGLLGPRGTPGAPGQPGMAGVDGPPGPKGNMGPQGEPGPPGQQGNPGPQGLPGPQG PIGPPGEK corresponding to amino acids 1-714 of CA1B_HUMAN (SEQ ID NO:1446), which also corresponds to amino acids 1-714 of HUMCA1XIA_P15 (SEQ ID NO:1373), and a second amino acid sequence being at least 70%, optionally at least 80%, preferably at least 85%, more preferably at least 90% and most preferably at least 95% homologous to a polypeptide having the sequence MCCNLSFGILIPLQK (SEQ ID NO: 257) corresponding to amino acids 715-729 of HUMCA1XIA_P15 (SEQ ID NO:1373), wherein said first amino acid sequence and second amino acid sequence are contiguous and in a sequential order.

According to preferred embodiments of the present invention, there is provided an isolated polypeptide encoding for a tail of HUMCA1XIA_P15 (SEQ ID NO:1373), comprising a polypeptide being at least 70%, optionally at least about 80%, preferably at least about 85%, more preferably at least about 90% and most preferably at least about 95% homologous to the sequence MCCNLSFGILIPLQK (SEQ ID NO: 257) in HUMCA1XIA_P15 (SEQ ID NO:1373) According to preferred embodiments of the present invention, there is provided an isolated chimeric polypeptide encoding for HUMCA1XIA_P116 (SEQ ID NO:1374), comprising a first amino acid sequence being at least 90% homologous to MEPWSSRWKTKRWLWDFTVTTLALTFLFQAREVRGAAPVDVLKALDFHNSPEGISKTT GFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTM IVDCKKKTTKPLDRSERAIVDTNGITVFGTRILDEEVFEGDIQQFLITGDPKAAYDYCEH YSPDCDSSAPKAAQAQEPQIDEYAPEDIIEYDYEYGEAEYKEAESVTEGPTVTEETIAQT EANIVDDFQEYNYGTMESYQTEAPRHVSGTNEPNPVEEIFTEEYLTGEDYDSQRKNSED TLYENKEIDGRDSDLLVDGDLGEYDFYEYKEYEDKPTSPPNEEFGPGVPAETDITETSIN GHGAYGEKGQKGEPAVVEPGMLVEGPPGPAGPAGIMGPPGLQGPTGPPGDPGDRGPPG RPGLPGADGLPGPPGTMLMLPFRYGGDGSKGPTISAQEAQAQAILQQARIALRGPPGPM GLTGRPGPVGGPGSSGAKGESGDPGPQGPRGVQGPPGPTGKPGKRGRPGADGGRGMP GEPGAKGDRGFDGLPGLPGDKGHRGERGPQGPPGPPGDDGMRGEDGEIGPRGLPGEA corresponding to amino acids 1-648 of CA1B_HUMAN (SEQ ID NO:1446), which also corresponds to amino acids 1-648 of HUMCA1XIA_P16 (SEQ ID NO:1374), a second amino acid sequence being at least 90% homologous to GMAGVDGPPGPKGNMGPQGEPGP-PGQQGNPGPQGLPGPQGPIGPPGEK corresponding to amino acids 667-714 of CA1B_HUMAN (SEQ ID NO:1446), which also corresponds to amino acids 649-696 of HUMCA1XIA_P16 (SEQ ID NO:1374), and a third amino acid sequence being at least 70%, optionally at least 80%, preferably at least 85%, more preferably at least 90% and most preferably at least 95% homologous to a polypeptide having the sequence VSFSFSLFYKKVIKFACD-KRFVGRHDERKVVKLSLPLYLIYE (SEQ ID NO: 258) corresponding to amino acids 697-738 of HUMCA1XIA_P16 (SEQ ID NO:1374), wherein said first amino acid sequence, second amino acid sequence and third amino acid sequence are contiguous and in a sequential order.

According to preferred embodiments of the present invention, there is provided an isolated chimeric polypeptide encoding for an edge portion of HUMCA1XIA_P16 (SEQ ID NO:1374), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AG, having a structure as follows: a sequence starting from any of amino acid numbers 648−x to 648; and ending at any of amino acid numbers 649+((n−2)−x), in which x varies from 0 to n−2.

According to preferred embodiments of the present invention, there is provided an isolated polypeptide encoding for a tail of HUMCA1XIA_P16 (SEQ ID NO:1374), comprising a polypeptide being at least 70%, optionally at least about 80%, preferably at least about 85%, more preferably at least about 90% and most preferably at least about 95% homologous to the sequence VSFSFSLFYKKVIKFACD-KRFVGRHDERKVVKLSLPLYLIYE (SEQ ID NO: 258) in HUMCA1XIA_P16 (SEQ ID NO:1374).

According to preferred embodiments of the present invention, there is provided an isolated chimeric polypeptide encoding for HUMCA1XIA_P17 (SEQ ID NO:1375), comprising a first amino acid sequence being at least 90% homologous to MEPWSSRWKTKRWLWDFTVTTLALT-FLFQAREVRGAAPVDVLKALDFHNSPEGISKTT GFCTNRKNSKGSDTAYRVSKQAQLSAPT-KQLFPGGTFPEDFSILFTVKPKKGIQSFLLSIY NEH-GIQQIGVEVGRSPVFLFEDHTGKPA-PEDYPLFRTVNIADGKWHRVAISVEKKTVTM IVDCKKKTTKPLDRSERAIVDTNGITVF-GTRILDEEVFEGDIQQFLITGDPKAAYDYCEH YSPD-CDSSAPKAAQAQEPQIDE corresponding to amino acids 1-260 of CA1B_HUMAN (SEQ ID NO:1446), which also corresponds to amino acids 1-260 of HUMCA1XIA_P17 (SEQ ID NO:1375), and a second amino acid sequence being at least 70%, optionally at least 80%, preferably at least 85%, more preferably at least 90% and most preferably at least 95% homologous to a polypeptide having the sequence VRSTR-PEKVFVFQ (SEQ ID NO: 259) corresponding to amino acids 261-273 of HUMCA1XIA_P17 (SEQ ID NO:1375), wherein said first amino acid sequence and second amino acid sequence are contiguous and in a sequential order.

According to preferred embodiments of the present invention, there is provided an isolated polypeptide encoding for a tail of HUMCA1XIA_P117 (SEQ ID NO:1375), comprising a polypeptide being at least 70%, optionally at least about 80%, preferably at least about 85%, more preferably at least about 90% and most preferably at least about 95% homologous to the sequence VRSTRPEKVFVFQ in HUMCA1XIA_P117 (SEQ ID NO:1375).

According to preferred embodiments of the present invention, there is provided an isolated chimeric polypeptide encoding for R20779_P2 (SEQ ID NO:1402), comprising a first amino acid sequence being at least 90% homologous to MCAERLGQFMTLALVLATFDPARGTDAT-NPPEGPQDRSSQQKGRLSLQNTAEIQHCLV NAGD-VGCGVFECFENNSCEIRGLHGICMTFLH-NAGKFDAQGKSFIKDALKCKAHALRH RFGCISRKCPAIREMVSQLQRECYLKH-DLCAAAQENTRVIVEMIHFKDLLLHE corresponding to amino acids 1-169 of STC2_HUMAN (SEQ ID NO:1458), which also corresponds to amino acids 1-169 of R20779_P2 (SEQ ID NO:1402), and a second amino acid sequence being at least 70%, optionally at least 80%, preferably at least 85%, more preferably at least 90% and most preferably at least 95% homologous to a polypeptide having the sequence CYKIE-ITMPKRRKVKLRD (SEQ ID NO: 260) corresponding to amino acids 170-187 of R20779_P2 (SEQ ID NO:1402), wherein said first amino acid sequence and second amino acid sequence are contiguous and in a sequential order.

According to preferred embodiments of the present invention, there is provided an isolated polypeptide encoding for a tail of R20779_P2 (SEQ ID NO:1402), comprising a polypeptide being at least 70%, optionally at least about 80%, preferably at least about 85%, more preferably at least about 90% and most preferably at least about 95% homologous to the sequence CYKIEITMPKRRKVKLRD (SEQ ID NO: 260) in R20779_P2 (SEQ ID NO:1402).

According to preferred embodiments of the present invention, there is provided an isolated chimeric polypeptide encoding for HUMOSTRO_PEA_1_PEA_1_P21 (SEQ ID NO:1627), comprising a first amino acid sequence being at least 90% homologous to MRIAVICF-CLLGITCAIPVKQADSGSSEEKQ-LYNKYPDAVATWLNPDPSQKQNLLAPQ corresponding to amino acids 1-58 of OSTP_HUMAN (SEQ ID NO:1462), which also corresponds to amino acids 1-58 of HUMOS-TRO_PEA_1_PEA_1_P21 (SEQ ID NO:1627), and a second amino acid sequence being at least 70%, optionally at least 80%, preferably at least 85%, more preferably at least 90% and most preferably at least 95% homologous to a polypeptide having the sequence VFLNFS (SEQ ID NO: 261) corresponding to amino acids 59-64 of HUMOSTRO_PEA_1_PEA_1_P21 (SEQ ID NO:1627), wherein said first amino acid sequence and second amino acid sequence are contiguous and in a sequential order.

According to preferred embodiments of the present invention, there is provided an isolated polypeptide encoding for a tail of HUMOSTRO_PEA_1_PEA_1_P21 (SEQ ID NO:1627), comprising a polypeptide being at least 70%, optionally at least about 80%, preferably at least about 85%, more preferably at least about 90% and most preferably at least about 95% homologous to the sequence VFLNFS (SEQ ID NO: 261) in HUMOSTRO_PEA_1_PEA_1_P21 (SEQ ID NO:1627).

According to preferred embodiments of the present invention, there is provided an isolated chimeric polypeptide encoding for HUMOSTRO_PEA_1_PEA_1_P25 (SEQ ID NO:1628), comprising a first amino acid sequence being at least 90% homologous to MRIAVICF-CLLGITCAIPVKQADSGSSEEKQ corresponding to amino acids 1-31 of OSTP_HUMAN (SEQ ID NO:1462), which also corresponds to amino acids 1-31 of HUMOSTRO_

PEA_1_PEA_1_P25 (SEQ ID NO:1628), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA_1_PEA_1_P25 (SEQ ID NO:1628), wherein said first amino acid sequence and second amino acid sequence are contiguous and in a sequential order.

According to preferred embodiments of the present invention, there is provided an isolated chimeric polypeptide encoding for HUMOSTRO_PEA_1_PEA_1_P30 (SEQ ID NO:1629), comprising a first amino acid sequence being at least 90% homologous to MRIAVICF-CLLGITCAIPVKQADSGSSEEKQ corresponding to amino acids 1-31 of OSTP_HUMAN (SEQ ID NO:1462), which also corresponds to amino acids 1-31 of HUMOSTRO_PEA_1_PEA_1_P30 (SEQ ID NO:1629), and a second amino acid sequence being at least 70%, optionally at least 80%, preferably at least 85%, more preferably at least 90% and most preferably at least 95% homologous to a polypeptide having the sequence VSIFYVFI (SEQ ID NO: 262) corresponding to amino acids 32-39 of HUMOSTRO_PEA_1_PEA_1_P30 (SEQ ID NO:1629), wherein said first amino acid sequence and second amino acid sequence are contiguous and in a sequential order.

According to preferred embodiments of the present invention, there is provided an isolated polypeptide encoding for a tail of HUMOSTRO_PEA_1_PEA_1_P30 (SEQ ID NO:1629), comprising a polypeptide being at least 70%, optionally at least about 80%, preferably at least about 85%, more preferably at least about 90% and most preferably at least about 95% homologous to the sequence VSIFYVFI (SEQ ID NO: 262) in HUMOSTRO_PEA_1_PEA_1_P30 (SEQ ID NO:1629).

According to preferred embodiments of the present invention, there is provided an isolated chimeric polypeptide encoding for HUMPHOSLIP_PEA_2_P10 (SEQ ID NO:1327), comprising a first amino acid sequence being at least 90% homologous to MALFGALFLALLAGAHAEF-PGCKIRVTSKALELVKQEGLRFLEQE-LETITIPDLRGKEGH FYYNISE corresponding to amino acids 1-67 of PLTP_HUMAN (SEQ ID NO:1433), which also corresponds to amino acids 1-67 of HUMPHOSLIP_PEA_2_P10 (SEQ ID NO:1327), and a second amino acid sequence being at least 90% homologous to KVYDFLST-FITSGMRFLLNQQICPVLYHAGTV-LLNSLLDTVPVRSSVDELVGIDYSLMK DPVASTSNLDMDFRGAFFPLTERNWSLP-NRAVEPQLQEEERMVYVAFSEFFFDSAMES YFRAGALQLLLVGDKVPHDLDMLLRATY-FGSIVLLSPAVIDSPLKLELRVLAPPRCTIKP SGTTIS-VTASVTIALVPPDQPEVQLSSMTMDARL-SAKMALRGKALRTQLDLRRFRIYSN HSALESLALIPLQAPLKTMLQIGVMPML-NERTWRGVQIPLPEGINFVHEVVTNHAGFLTI GADL-HFAKGLREVIEKNRPADVRASTAPTPSTAAV corresponding to amino acids 163-493 of PLTP_HUMAN (SEQ ID NO:1433), which also corresponds to amino acids 68-398 of HUMPHOSLIP_PEA_2_P10 (SEQ ID NO:1327), wherein said first amino acid sequence and second amino acid sequence are contiguous and in a sequential order.

According to preferred embodiments of the present invention, there is provided an isolated chimeric polypeptide encoding for an edge portion of HUMPHOSLIP_PEA_2_P10 (SEQ ID NO:1327), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EK, having a structure as follows: a sequence starting from any of amino acid numbers 67−x to 67; and ending at any of amino acid numbers 68+((n−2)−x), in which x varies from 0 to n−2.

According to preferred embodiments of the present invention, there is provided an isolated chimeric polypeptide encoding for HUMPHOSLIP_PEA_2_P12 (SEQ ID NO:1328), comprising a first amino acid sequence being at least 90% homologous to MALFGALFLALLAGAHAEF-PGCKIRVTSKALELVKQEGLRFLEQE-LETITIPDLRGKEGH FYYNISEVKVTELQLTSSELD-FQPQQELMLQITNASLGLRFRRQLLYWFFYDGGYI NAS AEGVSIRTGLELSRDPAGRMKVSNVSC-QASVSRMHAAFGGTFKKVYDFLSTFITSGMRF LLN-QQICPVLYHAGTVLLNSLLDTVPVRSS-VDELVGIDYSLMKDPVASTSNLDMDFRG AFFPLTERNWSLPNRAVEPQLQEEERM-VYVAFSEFFFDSAMESYFRAGALQLLLVGDK VPH-DLDMLLRATYFGSIVLLSPAVID-SPLKLELRVLAPPRCTIKPSGTTISVTASVTIALVP PDQPEVQLSSMTMDARLSAKMALRGKAL-RTQLDLRRFRIYSNHSALESLALIPLQAPLK TML-QIGVMPMLN corresponding to amino acids 1-427 of PLTP_HUMAN (SEQ ID NO:1433), which also corresponds to amino acids 1-427 of HUMPHOSLIP_PEA_2_P12 (SEQ ID NO:1328), and a second amino acid sequence being at least 70%, optionally at least 80%, preferably at least 85%, more preferably at least 90% and most preferably at least 95% homologous to a polypeptide having the sequence GKAGV (SEQ ID NO: 263) corresponding to amino acids 428-432 of HUMPHOSLIP_PEA_2_P12 (SEQ ID NO:1328), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P112 (SEQ ID NO:1328), comprising a polypeptide being at least 70%, optionally at least about 80%, preferably at least about 85%, more preferably at least about 90% and most preferably at least about 95% homologous to the sequence GKAGV (SEQ ID NO: 263) in HUMPHOSLIP_PEA_2_P12 (SEQ ID NO:1328).

According to preferred embodiments of the present invention, there is provided an isolated chimeric polypeptide encoding for HUMPHOSLIP_PEA_2_P31 (SEQ ID NO:1330), comprising a first amino acid sequence being at least 90% homologous to MALFGALFLALLAGAHAEF-PGCKIRVTSKALELVKQEGLRFLEQE-LETITIPDLRGKEGH FYYNISE corresponding to amino acids 1-67 of PLTP_HUMAN (SEQ ID NO:1433), which also corresponds to amino acids 1-67 of HUMPHOSLIP_PEA_2_P31 (SEQ ID NO:1330), and a second amino acid sequence being at least 70%, optionally at least 80%, preferably at least 85%, more preferably at least 90% and most preferably at least 95% homologous to a polypeptide having the sequence PGLERGADKFPVVGGSSLFLALDLTLRP-PVG (SEQ ID NO: 264) corresponding to amino acids 68-98 of HUMPHOSLIP_PEA_2_P31 (SEQ ID NO:1330), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P31 (SEQ ID NO:1330), comprising a polypeptide being at least 70%, optionally at least about 80%, preferably at least about 85%, more preferably at least about 90% and most preferably at least about 95% homologous to the sequence PGLERGADKFPV-VGGSSLFLALDLTLRPPVG (SEQ ID NO: 264) in HUMPHOSLIP_PEA_2_P31 (SEQ ID NO:1330).

According to preferred embodiments of the present invention, there is provided an isolated chimeric polypeptide encoding for HUMPHOSLIP_PEA_2_P33 (SEQ ID NO:1331), comprising a first amino acid sequence being at least 90% homologous to MALFGALFLALLAGAHAEF-PGCKIRVTSKALELVKQEGLRFLEQE-LETITIPDLRGKEGH FYYNISEVKVTELQLTSSELD-FQPQQELMLQITNASLGLRFRRQLLYWFFYDGGY INAS AEGVSIRTGLELSRDPAGRMKVSNVSC-QASVSRMHAAFGGTFKKVYDFLSTFITSGMRF LLNQQ corresponding to amino acids 1-183 of PLTP_HUMAN (SEQ ID NO:1433), which also corresponds to amino acids 1-183 of HUMPHOSLIP_PEA_2_P33 (SEQ ID NO:1331), and a second amino acid sequence being at least 70%, optionally at least 80%, preferably at least 85%, more preferably at least 90% and most preferably at least 95% homologous to a polypeptide having the sequence VWAAT-GRRVARVGMLSL (SEQ ID NO: 265) corresponding to amino acids 184-200 of HUMPHOSLIP_PEA_2_P33 (SEQ ID NO:1331), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P33 (SEQ ID NO:1331), comprising a polypeptide being at least 70%, optionally at least about 80%, preferably at least about 85%, more preferably at least about 90% and most preferably at least about 95% homologous to the sequence VWAATGRRVARVG-MLSL (SEQ ID NO: 265) in HUMPHOSLIP_PEA_2_P33 (SEQ ID NO:1331).

According to preferred embodiments of the present invention, there is provided an isolated chimeric polypeptide encoding for HUMPHOSLIP_PEA_2_P34 (SEQ ID NO:1332), comprising a first amino acid sequence being at least 90% homologous to MALFGALFLALLAGAHAEF-PGCKIRVTSKALELVKQEGLRFLEQE-LETITIPDLRGKEGH FYYNISEVKVTELQLTSSELD-FQPQQELMLQITNASLGLRFRRQLLYWFFYDGGYI NAS AEGVSIRTGLELSRDPAGRMKVSNVSC-QASVSRMHAAFGGTFKKVYDFLSTFITSGMRF LLN-QQICPVLYHAGTVLLNSLLDTVPV corresponding to amino acids 1-205 of PLTP_HUMAN (SEQ ID NO:1433), which also corresponds to amino acids 1-205 of HUMPH-OSLIP_PEA_2_P34 (SEQ ID NO:1332), and a second amino acid sequence being at least 70%, optionally at least 80%, preferably at least 85%, more preferably at least 90% and most preferably at least 95% homologous to a polypeptide having the sequence LWTSLLALTIPS (SEQ ID NO: 266) corresponding to amino acids 206-217 of HUMPH-OSLIP_PEA_2_P34 (SEQ ID NO:1332), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P34 (SEQ ID NO:1332), comprising a polypeptide being at least 70%, optionally at least about 80%, preferably at least about 85%, more preferably at least about 90% and most preferably at least about 95% homologous to the sequence LWTSLLALTIPS (SEQ ID NO: 266) in HUMPHOSLIP_PEA_2_P34 (SEQ ID NO:1332).

According to preferred embodiments of the present invention, there is provided an isolated chimeric polypeptide encoding for HUMPHOSLIP_PEA_2_P35 (SEQ ID NO:1333), comprising a first amino acid sequence being at least 90% homologous to MALFGALFLALLAGAHAEF-PGCKIRVTSKALELVKQEGLRFLEQE-LETITIPDLRGKEGH FYYNISEVKVTELQLTSSELD-FQPQQELMLQITNASLGLRFRRQLLYWF corresponding to amino acids 1-109 of PLTP_HUMAN (SEQ ID NO:1433), which also corresponds to amino acids 1-109 of HUMPHOSLIP_PEA_2_P35 (SEQ ID NO:1333), a second amino acid sequence bridging amino acid sequence comprising of L, a third amino acid sequence being at least 90% homologous to KVYDFLSTFITSGMRFLLNQQ corresponding to amino acids 163-183 of PLTP_HUMAN (SEQ ID NO:1433), which also corresponds to amino acids 111-131 of HUMPHOSLIP_PEA_2_P35 (SEQ ID NO:1333), and a fourth amino acid sequence being at least 70%, optionally at least 80%, preferably at least 85%, more preferably at least 90% and most preferably at least 95% homologous to a polypeptide having the sequence VWAATGRRVARVG-MLSL (SEQ ID NO: 265) corresponding to amino acids 132-148 of HUMPHOSLIP_PEA_2_P35 (SEQ ID NO:1333), wherein said first amino acid sequence, second amino acid sequence, third amino acid sequence and fourth amino acid sequence are contiguous and in a sequential order.

According to preferred embodiments of the present invention, there is provided an isolated polypeptide encoding for an edge portion of HUMPHOSLIP_PEA_2_P35 (SEQ ID NO:1333), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FLK having a structure as follows (numbering according to HUMPHOSLIP_PEA_P35 (SEQ ID NO:1333)): a sequence starting from any of amino acid numbers 109−x to 109; and ending at any of amino acid numbers 111+((n−2)−x), in which x varies from 0 to n−2.

According to preferred embodiments of the present invention, there is provided an isolated polypeptide encoding for a tail of HUMPHOSLIP_PEA_2_P35 (SEQ ID NO:1333), comprising a polypeptide being at least 70%, optionally at least about 80%, preferably at least about 85%, more preferably at least about 90% and most preferably at least about 95% homologous to the sequence VWAATGRRVARVG-MLSL (SEQ ID NO: 265) in HUMPHOSLIP_PEA_2_P35 (SEQ ID NO:1333).

According to preferred embodiments of the present invention, there is provided an isolated chimeric polypeptide encoding for R38144_PEA_2_P6 (SEQ ID NO:1403), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLEYNKAIRNYTR FDDW-YLWVQMYKGTVSMPVFQSLEAYWPGLQS-LIGDIDNAMRTFLNYYTVWKQFGG LPEFYNIPQGYTVEKREGYPLRPELIE-SAMYLYRATGDPTLLELGRDAVESIEKISKVEC GFAT corresponding to amino acids 1-412 of CT31_HUMAN (SEQ ID NO:1459), which also corresponds to amino acids 1-412 of R38144_PEA_2_P6 (SEQ ID NO:1403), and a second amino acid sequence being at least 70%, optionally at least 80%, preferably at least 85%, more preferably at least 90% and most preferably at least 95% homologous to a polypeptide having the sequence LASFSHMSDQRSAR-PQAGQPHGVVLPGRDCEIPLPPV (SEQ ID NO: 268) corresponding to amino acids 413-449 of R38144_PEA_2_P6 (SEQ ID NO:1403), wherein said first amino acid sequence and second amino acid sequence are contiguous and in a sequential order.

According to preferred embodiments of the present invention, there is provided an isolated polypeptide encoding for a tail of R38144_PEA_2_P6 (SEQ ID NO:1403), comprising a polypeptide being at least 70%, optionally at least about 80%, preferably at least about 85%, more preferably at least about 90% and most preferably at least about 95% homologous to the sequence LASFSHMSDQRSARPQAGQPHGV-VLPGRDCEIPLPPV (SEQ ID NO: 268) in R38144_PEA_2_P6 (SEQ ID NO:1403).

According to preferred embodiments of the present invention, there is provided an isolated chimeric polypeptide encoding for R38144_PEA_2_P13 (SEQ ID NO:1404), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLEYNKAIRNYTR FDDW-YLWVQMYKGTVSMPVFQSLEAYWPGLQ corresponding to amino acids 1-323 of CT31_HUMAN (SEQ ID NO:1459), which also corresponds to amino acids 1-323 of R38144_PEA_2_P13 (SEQ ID NO:1404), and a second amino acid sequence being at least 70%, optionally at least 80%, preferably at least 85%, more preferably at least 90% and most preferably at least 95% homologous to a polypeptide having the sequence NLLKAQCTSTVPRGIPPS (SEQ ID NO: 269) corresponding to amino acids 324-341 of R38144_PEA_2_P13 (SEQ ID NO:1404), wherein said first amino acid sequence and second amino acid sequence are contiguous and in a sequential order.

According to preferred embodiments of the present invention, there is provided an isolated polypeptide encoding for a tail of R38144_PEA_2_P13 (SEQ ID NO:1404), comprising a polypeptide being at least 70%, optionally at least about 80%, preferably at least about 85%, more preferably at least about 90% and most preferably at least about 95% homologous to the sequence NLLKAQCTSTVPRGIPPS (SEQ ID NO: 269) in R38144_PEA_2_P13 (SEQ ID NO:1404).

According to preferred embodiments of the present invention, there is provided an isolated chimeric polypeptide encoding for R38144_PEA_2_P15 (SEQ ID NO:1405), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLE corresponding to amino acids 1-282 of CT31_HUMAN (SEQ ID NO:1459), which also corresponds to amino acids 1-282 of R38144_PEA_2_P15 (SEQ ID NO:1405), and a second amino acid sequence being at least 70%, optionally at least 80%, preferably at least 85%, more preferably at least 90% and most preferably at least 95% homologous to a polypeptide having the sequence PHWRH (SEQ ID NO: 270) corresponding to amino acids 283-287 of R38144_PEA_2_P15 (SEQ ID NO:1405), wherein said first amino acid sequence and second amino acid sequence are contiguous and in a sequential order.

According to preferred embodiments of the present invention, there is provided an isolated polypeptide encoding for a tail of R38144_PEA_2_P15 (SEQ ID NO:1405), comprising a polypeptide being at least 70%, optionally at least about 80%, preferably at least about 85%, more preferably at least about 90% and most preferably at least about 95% homologous to the sequence PHWRH (SEQ ID NO: 270) in R38144_PEA_2_P15 (SEQ ID NO:1405).

According to preferred embodiments of the present invention, there is provided an isolated chimeric polypeptide encoding for R38144_PEA_2_P19 (SEQ ID NO:1406), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLEYNKAIRNYTR FDDW-YLWVQMYKGTVSMPVFQSLEAYWPGLQS-LIGDIDNAMRTFLNYYTVWKQFGG LPEFYNIPQGYTVEKREGYPLRPELIE-SAMYLYRATGDPTLLELGRDAVESIEKISKVEC GFAT corresponding to amino acids 1-412 of CT31_HUMAN (SEQ ID NO:1459), which also corresponds to amino acids 1-412 of R38144_PEA_2_P19 (SEQ ID NO:1406), and a second amino acid sequence being at least 70%, optionally at least 80%, preferably at least 85%, more preferably at least 90% and most preferably at least 95% homologous to a polypeptide having the sequence KRSRSVA-QAGVQWCDHDSPQP (SEQ ID NO: 270) corresponding to amino acids 413-433 of R38144_PEA_2_P19 (SEQ ID NO:1406), wherein said first amino acid sequence and second amino acid sequence are contiguous and in a sequential order.

According to preferred embodiments of the present invention, there is provided an isolated polypeptide encoding for a tail of R38144_PEA_2_P19 (SEQ ID NO:1406), comprising a polypeptide being at least 70%, optionally at least about 80%, preferably at least about 85%, more preferably at least about 90% and most preferably at least about 95% homologous to the sequence KRSRSVAQAGVQWCDHDSPQP (SEQ ID NO: 270) in R38144_PEA_2_P19 (SEQ ID NO:1406).

According to preferred embodiments of the present invention, there is provided an isolated chimeric polypeptide encoding for R38144_PEA_2_P24 (SEQ ID NO:1407), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIR corresponding to amino acids 1-121 of CT31_HUMAN (SEQ ID NO:1459), which also corresponds to amino acids 1-121 of R38144_PEA_2_P24 (SEQ ID NO:1407), and a second amino acid sequence being at least 90% homologous to EYNKAIRNYTRFDDWYL-WVQMYKGTVSMPVFQSLEAYWPGLQS-LIGDIDNAMRTFLN YYTVWKQFGGLPE-FYNIPQGYTVEKREGYPLRPELIESAMYLYRATGDP TLLELGRDA VESIEKISKVECGFATIKDLRDHKLDN-RMESFFLAETVKYLYLLFDPTNFIHNNGSTFDA VIT-PYGECILGAGGYIFNTEAHPIDPAALHC-CQRLKEEQWEVEDLMREFYSLKRSRSKFQ KNTVSSGPWEPPARPGTLFSPEN-HDQARERKPAKQKVPLLSCPSQPFTSKLALLGQVFL DSS corresponding to amino acids 282-578 of CT31_HUMAN (SEQ ID NO:1459), which also corresponds to amino acids 122-418 of R38144_PEA_2_P24 (SEQ ID NO:1407), wherein said first amino acid sequence and second amino acid sequence are contiguous and in a sequential order.

According to preferred embodiments of the present invention, there is provided an isolated chimeric polypeptide encoding for an edge portion of R38144_PEA_2_P24 (SEQ ID NO:1407), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RE, having a structure as follows: a sequence starting from any of amino acid numbers 121–x to 121; and ending at any of amino acid numbers 122+((n−2)−x), in which x varies from 0 to n−2.

According to preferred embodiments of the present invention, there is provided an isolated chimeric polypeptide encoding for R38144_PEA_2_P36 (SEQ ID NO:1408), comprising a first amino acid sequence being at least 90% homologous to MPFRLLIPLGLLCALLPQHHGAPGPDG-SAPDPAHYR corresponding to amino acids 1-36 of AAH16184 (SEQ ID NO:1460), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGM-SQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

According to preferred embodiments of the present invention, there is provided an isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWT-LILM (SEQ ID NO: 272) in R38144_PEA_2_P36 (SEQ ID NO:1408).

According to preferred embodiments of the present invention, there is provided an isolated chimeric polypeptide encoding for R38144_PEA_2_P36 (SEQ ID NO:1408), comprising a first amino acid sequence being at least 90% homologous to MPFRLLIPLGLLCALLPQHHGAPGPDG-SAPDPAHY corresponding to amino acids 1-35 of AAQ88943 (SEQ ID NO:1461), which also corresponds to amino acids 1-35 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence RFWGM-SQNSKEWLKCSRTAWTLILM corresponding to amino acids 36-60 of R38144_PEA_2_P36 (SEQ ID NO:1408), wherein said first amino acid sequence and second amino acid sequence are contiguous and in a sequential order.

According to preferred embodiments of the present invention, there is provided an isolated polypeptide encoding for a tail of R38144_PEA_2_P36 (SEQ ID NO:140.8), comprising a polypeptide being at least 70%, optionally at least about 80%, preferably at least about 85%, more preferably at least about 90% and most preferably at least about 95% homologous to the sequence RFWGMSQNSKEWLKCSRTAWT-LILM in R38144_PEA_2_P36 (SEQ ID NO:1408).

According to preferred embodiments of the present invention, there is provided an isolated chimeric polypeptide encoding for R38144_PEA_2_P36 (SEQ ID NO:1408), comprising a first amino acid sequence being at least 90% homologous to MPFRLLIPLGLLCALLPQHHGAPGPDG-SAPDPAHYR corresponding to amino acids 1-36 of CT31_HUMAN (SEQ ID NO:1459), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGM-SQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

According to preferred embodiments of the present invention, there is provided an isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWT-LILM (SEQ ID NO: 272) in R38144_PEA_2_P36 (SEQ ID NO:1408).

According to preferred embodiments of the present invention, there is provided an isolated chimeric polypeptide encoding for AA161187_P6 (SEQ ID NO:1319), comprising a first amino acid sequence being at least 70%, optionally at least 80%, preferably at least 85%, more preferably at least 90% and most preferably at least 95% homologous to a polypeptide having the sequence HTREGTLGGQKRAFP-DGVEGEKGRGRAWGAASRGSAVPLTIR (SEQ ID NO: 273) corresponding to amino acids 1-42 of AA161187_P6 (SEQ ID NO:1319), and a second amino acid sequence being at least 90% homologous to GPCGRRVITSRIVGGEDAEL-GRWPWQGSLRLWDSHVCGVSLLSHRWAL-TAAHCFETYS DLSDPSGWMVQFGQLTSMPSFWS-LQAYYTRYFVSNIYLSPRYLGNSPYDIALVKLSAPV TYTKHIQPICLQASTFEFENRTDCWVTG-WGYIKEDEALPSPHTLQEVQVAIINNSMCNH LFLKYSFRKDIFGDMVCAGNAQGGK-DACFGDSGGPLACNKNGLWYQIGVVSWGVGC GRP-NRPGVYTNISHHFEWIQKLMAQSGMSQP-DPSWPLLFFPLLWALPLLGPV corresponding to amino acids 31-314 of TEST_HUMAN (SEQ ID NO:1431), which also corresponds to amino acids 43-326 of AA161187_P6 (SEQ ID NO:1319), wherein said first amino acid sequence and second amino acid sequence are contiguous and in a sequential order.

According to preferred embodiments of the present invention, there is provided an isolated polypeptide encoding for a head of AA161187_P6 (SEQ ID NO:1319), comprising a polypeptide being at least 70%, optionally at least about 80%, preferably at least about 85%, more preferably at least about 90% and most preferably at least about 95% homologous to the sequence HTREGTLGGQKRAFPDGVEGEKGR-GRAWGAASRGSAVPLTIR (SEQ ID NO: 273) of AA161187_P6 (SEQ ID NO:1319).

According to preferred embodiments of the present invention, there is provided an isolated chimeric polypeptide encoding for AA161187_P13 (SEQ ID NO:1320), comprising a first amino acid sequence being at least 90% homologous to MGARGALLLALLLARAGLRKPESQEAA-PLSGPCGRRVITSRIVGGEDAELGRWPWQGS LRLWDSHVCGVSLLSHRWALTAAHCFE-TYSDLSDPSGWMVQFGQLTSMPSFWSLQAY YTRY-FVSNIYLSPRYLGNSPYDIALVKLSAPV-TYTKHIQPICLQASTFEFENRTDCWVTG WGYIKEDE corresponding to amino acids 1-183 of TEST_HUMAN (SEQ ID NO:1431), which also corresponds to amino acids 1-183 of AA161187_P13 (SEQ ID NO:1320), and a second amino acid sequence being at least 70%, optionally at least 80%, preferably at least 85%, more preferably at least 90% and most preferably at least 95% homologous to a polypeptide having the sequence GSSGRHHKQLYVQPPLPQVQF-PQGHLWRHG (SEQ ID NO: 274) corresponding to amino acids 184-213 of AA161187_P13 (SEQ ID NO:1320), wherein said first amino acid sequence and second amino acid sequence are contiguous and in a sequential order.

According to preferred embodiments of the present invention, there is provided an isolated polypeptide encoding for a tail of AA161187_P13 (SEQ ID NO:1320), comprising a polypeptide being at least 70%, optionally at least about 80%, preferably at least about 85%, more preferably at least about 90% and most preferably at least about 95% homologous to the sequence GSSGRHHKQLYVQPPLPQVQFPQGHL-WRHG (SEQ ID NO: 274) in AA161187_P13 (SEQ ID NO:1320).

According to preferred embodiments of the present invention, there is provided an isolated chimeric polypeptide encoding for AA161187_P14 (SEQ ID NO:1321), comprising a first amino acid sequence being at least 90% homologous to MGARGALLLALLLARAGLRKPESQEAA-PLSGPCGRRVITSRIVGGEDAELGRWPWQGS LRLWDSHVCGVSLLSHRWALTAAHCFE-TYSDLSDPSGWMVQFGQLTSMPSFWSLQAY YTRY-FVSNIYLSPRYLGNSPYDIALVKLSAPV-TYTKHIQPICLQASTFEFENRTDCWVTG WGYIKEDE corresponding to amino acids 1-183 of TEST_HUMAN (SEQ ID NO:1431), which also corresponds to amino acids 1-183 of AA161187_P14 (SEQ ID NO:1321), and a second amino acid sequence being at least 70%, optionally at least 80%, preferably at least 85%, more preferably at least 90% and most preferably at least 95% homologous to a polypeptide having the sequence GCCLSPSHYRPHSTAISPHP-PGSSGRHHKQLYVQPPLPQVQFPQGHL-WRHGLCWQCPRR EGCLLRECPCHHSQPRKAS-CVPVPYLTLMPTPGGGDCCPTLQM-QKRRLGCCQGEEEDV HPVYPAP (SEQ ID NO: 275) corresponding to amino acids 184-307 of AA161187_P14 (SEQ ID NO:1321), wherein said first amino acid sequence and second amino acid sequence are contiguous and in a sequential order.

According to preferred embodiments of the present invention, there is provided an isolated polypeptide encoding for a tail of AA161187_P14 (SEQ ID NO:1321), comprising a polypeptide being at least 70%, optionally at least about 80%, preferably at least about 85%, more preferably at least about 90% and most preferably at least about 95% homologous to the sequence GCCLSPSHYRPHSTAISPHPPGSSGRHH-KQLYVQPPLPQVQFPQGHLWRHGLCWQCPRR EGCLLRECPCHHSQPRKAS-CVPVPYLTLMPTPGGGDCCPTLQM-QKRRLGCCQGEEEDV HPVYPAP (SEQ ID NO: 275) in AA161187_P14 (SEQ ID NO:1321).

According to preferred embodiments of the present invention, there is provided an isolated chimeric polypeptide encoding for AA161187_P18 (SEQ ID NO:1322), comprising a first amino acid sequence being at least 70%, optionally at least 80%, preferably at least 85%, more preferably at least 90% and most preferably at least 95% homologous to a polypeptide having the sequence HTREGTLGGQKRAFP-DGVEGEKGRGRAWGAASRGSAVPLTIR (SEQ ID NO: 273) corresponding to amino acids 1-42 of AA161187_P18 (SEQ ID NO:1322), a second amino acid sequence being at least 90% homologous to GPCGRRVITSRIVGGEDAEL-GRWPWQGSLRLWDSHVCGVSLLSHRWAL-TAAHCFET corresponding to amino acids 31-86 of TEST_HUMAN (SEQ ID NO:14311), which also corresponds to amino acids 43-98 of AA161187_P18 (SEQ ID NO:1322), a third amino acid sequence being at least 90% homologous to DLSDPSGWMVQFGQLTSMPSFWS-LQAYYTRYFVSNIYLSPRYLGNSPYDIALVKLSAPV TYTKHIQPICLQASTFEFENRTDCWVTG-WGYIKEDEALPSPHTLQEVQVAIINNSMCNH LFLKYSFRKDIFGDMVCAGNAQGGKDACF corresponding to amino acids 89-235 of TEST_HUMAN (SEQ ID NO:1431), which also corresponds to amino acids 99-245 of AA161187_P18 (SEQ ID NO:1322), and a fourth amino acid sequence being at least 70%, optionally at least 80%, preferably at least 85%, more preferably at least 90% and most preferably at least 95% homologous to a polypeptide having the sequence VSVPATTPSPGKHPVSLCLI (SEQ ID NO: 277) corresponding to amino acids 246-265 of AA161187_P18 (SEQ ID NO:1322), wherein said first amino acid sequence, second amino acid sequence, third amino acid sequence and fourth amino acid sequence are contiguous and in a sequential order.

According to preferred embodiments of the present invention, there is provided an isolated polypeptide encoding for a head of AA161187_P18 (SEQ ID NO:1322), comprising a polypeptide being at least 70%, optionally at least about 80%, preferably at least about 85%, more preferably at least about 90% and most preferably at least about 95% homologous to the sequence HTREGTLGGQKRAFPDGVEGEKGR-GRAWGAASRGSAVPLTIR (SEQ ID NO: 273) of AA161187_P18 (SEQ ID NO:1322).

According to preferred embodiments of the present invention, there is provided an isolated chimeric polypeptide encoding for an edge portion of AA161187_P18 (SEQ ID NO:1322), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 98−x to 99; and ending at any of amino acid numbers 99+((n−2)−x), in which x varies from 0 to n−2.

According to preferred embodiments of the present invention, there is provided an isolated polypeptide encoding for a tail of AA161187_P18 (SEQ ID NO:1322), comprising a polypeptide being at least 70%, optionally at least about 80%, preferably at least about 85%, more preferably at least about 90% and most preferably at least about 95% homologous to the sequence VSVPATTPSPGKHPVSLCLI (SEQ ID NO: 277) in AA161187_P18 (SEQ ID NO:1322).

According to preferred embodiments of the present invention, there is provided an isolated chimeric polypeptide encoding for AA161187_P19 (SEQ ID NO:1323), comprising a first amino acid sequence being at least 90% homologous to MGARGALLLALLLARAGLRKPESQEAA-PLSGPCGRRVITSRIVGGEDAELGRWPWQGS LRLWDSHVCGVSLLSHRWALTAAHCFE-TYSDLSDPSGWMVQFGQLTSMPSFWSLQAY YTRY-FVSNIYLSPRYLGNSPYDIALVKLSAPV-TYTKHIQPICLQASTFEFENRTDCWVTG WGYIKEDE corresponding to amino acids 1-183 of TEST_HUMAN (SEQ ID NO:1431), which also corresponds to amino acids 1-183 of AA161187_P19 (SEQ ID NO:1323), and a second amino acid sequence being at least 70%, optionally at least 80%, preferably at least 85%, more preferably at least 90% and most preferably at least 95% homologous to a polypeptide having the sequence DKRTQ (SEQ ID NO: 278) corresponding to amino acids 184-188 of AA161187_P19 (SEQ ID NO:1323), wherein said first amino acid sequence and second amino acid sequence are contiguous and in a sequential order.

According to preferred embodiments of the present invention, there is provided an isolated polypeptide encoding for a tail of AA161187_P19 (SEQ ID NO:1323), comprising a polypeptide being at least 70%, optionally at least about 80%, preferably at least about 85%, more preferably at least about 90% and most preferably at least about 95% homologous to the sequence DKRTQ (SEQ ID NO: 278) in AA161187_P19 (SEQ ID NO:1323).

According to preferred embodiments of the present invention, there is provided an isolated chimeric polypeptide encoding for Z25299_PEA_2_P2 (SEQ ID NO:1390), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN (SEQ ID NO:1454), which also corresponds to amino acids 1-131 of Z25299_PEA_2_P2 (SEQ ID NO:1390), and a second amino acid sequence being at least 70%, optionally at least 80%, preferably at least 85%, more preferably at least 90% and most preferably at least 95% homologous to a polypeptide having the sequence GKQGM-RAH (SEQ ID NO: 279) corresponding to amino acids 132-139 of Z25299_PEA_2_P2 (SEQ ID NO:1390), wherein said first and second amino acid sequences are contiguous and in a sequential order.

According to preferred embodiments of the present invention, there is provided an isolated polypeptide encoding for a tail of Z25299_PEA_2_P2 (SEQ ID NO:1390), comprising a polypeptide being at least 70%, optionally at least about 80%, preferably at least about 85%, more preferably at least about 90% and most preferably at least about 95% homologous to the sequence GKQGMRAH (SEQ ID NO: 279) in Z25299_PEA_2_P2 (SEQ ID NO:1390).

According to preferred embodiments of the present invention, there is provided an isolated chimeric polypeptide encoding for Z25299_PEA_2_P3 (SEQ ID NO:1391), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN (SEQ ID NO:1454), which also corresponds to amino acids 1-131 of Z25299_PEA_2_P3 (SEQ ID NO:1391), and a second amino acid sequence being at least 70%, optionally at least 80%, preferably at least 85%, more preferably at least 90% and most preferably at least 95% homologous to a polypeptide having the sequence GEKRHHKQLRDQEVDPLEMRRHSAG (SEQ ID NO: 269) corresponding to amino acids 132-156 of Z25299_PEA_2_P3 (SEQ ID NO:1391), wherein said first and second amino acid sequences are contiguous and in a sequential order.

According to preferred embodiments of the present invention, there is provided an isolated polypeptide encoding for a tail of Z25299_PEA_2_P3 (SEQ ID NO:1391), comprising a polypeptide being at least 70%, optionally at least about 80%, preferably at least about 85%, more preferably at least about 90% and most preferably at least about 95% homologous to the sequence GEKRHHKQLRDQEVDPLEM-RRHSAG (SEQ ID NO: 269) in Z25299_PEA_2_P3 (SEQ ID NO:1391).

According to preferred embodiments of the present invention, there is provided an isolated chimeric polypeptide encoding for Z25299_PEA_2_P7 (SEQ ID NO:1392), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNP corresponding to amino acids 1-81 of ALK1_HUMAN (SEQ ID NO:1454), which also corresponds to amino acids 1-81 of Z25299_PEA_2_P7 (SEQ ID NO:1392), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 622) corresponding to amino acids 82-89 of Z25299_PEA_2_P7 (SEQ ID NO:1392), wherein said first and second amino acid sequences are contiguous and in a sequential order.

According to preferred embodiments of the present invention, there is provided an isolated polypeptide encoding for a tail of Z25299_PEA_2_P7 (SEQ ID NO:1392), comprising a polypeptide being at least 70%, optionally at least about 80%, preferably at least about 85%, more preferably at least about 90% and most preferably at least about 95% homologous to the sequence RGSLGSAQ (SEQ ID NO: 622) in Z25299_PEA_2_P7 (SEQ ID NO:1392).

According to preferred embodiments of the present invention, there is provided an isolated chimeric polypeptide encoding for Z25299_PEA_2_P10 (SEQ ID NO:1393), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPT corresponding to amino acids 1-82 of ALK1_HUMAN (SEQ ID NO:1454), which also corresponds to amino acids 1-82 of Z25299_PEA_2_P10 (SEQ ID NO:1393).

According to preferred embodiments of the present invention, there is provided an isolated chimeric polypeptide encoding for R66178_P3 (SEQ ID NO:1324), comprising a first amino acid sequence being at least 90% homologous to MARMGLAGAAGRWWGLALGL-TAFFLPGVHSQVVQVNDSMYGFIGTDVVLHCSFANP LPSVKITQVTWQKSTNGSKQN-VAIYNPSMGVSVLAPYRERVEFLRPS-FTDGTIRLSRLEL EDEGVYICEFATFPTGNRESQLN-LTVMAKPTNWIEGTQAVLRAKKGQDDKVLVATCTS ANGKPPSVVSWETRLKGEAEYQEIRNP-
NGTVTVISRYRLVPSREAHQQSLACIVNYHM
DRFKESLTLNVQYEPEVTIEGFDGNW-
YLQRMDVKLTCKADANPPATEYHWTTLNGSLP
KGVEAQNRTLFFKGPINYSLAG-
TYICEATNPIGTRSGQVEVNIT corresponding to amino acids 1-334 of PVR1_HUMAN (SEQ ID NO:1432), which also corresponds to amino acids 1-334 of R66178_P3 (SEQ ID NO:1324), and a second amino acid sequence being at least 70%, optionally at least 80%, preferably at least 85%, more preferably at least 90% and most preferably at least 95% homologous to a polypeptide having the sequence GEGH-SLPISPGVLQTQNCGP (SEQ ID NO: 694) corresponding to amino acids 335-354 of R66178_P3 (SEQ ID NO:1324), wherein said first amino acid sequence and second amino acid sequence are contiguous and in a sequential order.

According to preferred embodiments of the present invention, there is provided an isolated polypeptide encoding for a tail of R66178_P3 (SEQ ID NO:1324), comprising a polypeptide being at least 70%, optionally at least about 80%, preferably at least about 85%, more preferably at least about 90% and most preferably at least about 95% homologous to the sequence GEGHSLPISPGVLQTQNCGP (SEQ ID NO: 694) in R66178_P3 (SEQ ID NO:1324).

According to preferred embodiments of the present invention, there is provided an isolated chimeric polypeptide encoding for R66178_P4 (SEQ ID NO:1325), comprising a first amino acid sequence being at least 90% homologous to MARMGLAGAAGRWWGLALGL-
TAFFLPGVHSQVVQVNDSMYGFIGTDVVLHCSFANP
LPSVKITQVTWQKSTNGSKQN-
VAIYNPSMGVSVLAPYRERVEFLRPS-
FTDGTIRLSRLEL EDEGVYICEFATFPTGNRESQLN-
LTVMAKPTNWIEGTQAVLRAKKGQDDKVLVATCTS
ANGKPPSVVSWETRLKGEAEYQEIRNP-
NGTVTVISRYRLVPSREAHQQSLACIVNYHM
DRFKESLTLNVQYEPEVTIEGFDGNW-
YLQRMDVKLTCKADANPPATEYHWTTLNGSLP
KGVEAQNRTLFFKGPINYSLAG-
TYICEATNPIGTRSGQVEVNIT corresponding to amino acids 1-334 of PVR1_HUMAN (SEQ ID NO:1432), which also corresponds to amino acids 1-334 of R66178_P4 (SEQ ID NO:1325), and a second amino acid sequence being at least 70%, optionally at least 80%, preferably at least 85%, more preferably at least 90% and most preferably at least 95% homologous to a polypeptide having the sequence AFC-QLIYPGKGRTRARMF (SEQ ID NO:1702) corresponding to amino acids 335-352 of R66178_P4 (SEQ ID NO:1325), wherein said first amino acid sequence and second amino acid sequence are contiguous and in a sequential order.

According to preferred embodiments of the present invention, there is provided an isolated polypeptide encoding for a tail of R66178_P4 (SEQ ID NO:1325), comprising a polypeptide being at least 70%, optionally at least about 80%, preferably at least about 85%, more preferably at least about 90% and most preferably at least about 95% homologous to the sequence AFCQLIYPGKGRTRARMF (SEQ ID NO:1702) in R66178_P4 (SEQ ID NO:1325).

According to preferred embodiments of the present invention, there is provided an isolated chimeric polypeptide encoding for R66178_P8 (SEQ ID NO:1326), comprising a first amino acid sequence being at least 90% homologous to MARMGLAGAAGRWWGLALGL-
TAFFLPGVHSQVVQVNDSMYGFIGTDVVLHCSFANP
LPSVKITQVTWQKSTNGSKQN-
VAIYNPSMGVSVLAPYRERVEFLRPS-
FTDGTIRLSRLEL EDEGVYICEFATFPTGNRESQLN-
LTVMAKPTNWIEGTQAVLRAKKGQDDKVLVATCTS
ANGKPPSVVSWETRLKGEAEYQEIRNP-
NGTVTVISRYRLVPSREAHQQSLACIVNYHM
DRFKESLTLNVQYEPEVTIEGFDGNW-
YLQRMDVKLTCKADANPPATEYHWTTLNGSLP
KGVEAQNRTLFFKGPINYSLAG-
TYICEATNPIGTRSGQVE corresponding to amino acids 1-330 of PVR1_HUMAN (SEQ ID NO:1432), which also corresponds to amino acids 1-330 of R66178_P8 (SEQ ID NO:1326), and a second amino acid sequence being at least 70%, optionally at least 80%, preferably at least 85%, more preferably at least 90% and most preferably at least 95% homologous to a polypeptide having the sequence NSPT-PRLLPNMGGAPGRCPRPSLGAWRGASCWC (SEQ ID NO:1717) corresponding to amino acids 331-363 of R66178_P8 (SEQ ID NO:1326), wherein said first amino acid sequence and second amino acid sequence are contiguous and in a sequential order.

According to preferred embodiments of the present invention, there is provided an isolated polypeptide encoding for a tail of R66178_P8 (SEQ ID NO:1326), comprising a polypeptide being at least 70%, optionally at least about 80%, preferably at least about 85%, more preferably at least about 90% and most preferably at least about 95% homologous to the sequence NSPTPRLLPNMGGAPGRCPRPSLGAWR-GASCWC (SEQ ID NO:1717) in R66178_P8 (SEQ ID NO:1326).

According to preferred embodiments of the present invention, there is provided an isolated chimeric polypeptide encoding for HSU33147_PEA__1_P5 (SEQ ID NO:1415), comprising a first amino acid sequence being at least 90% homologous to MKLLMVLMLAALSQHCYAGSGCPL-LENVISKTINPQVSKTEYKELLQEFIDDNATTNAI DELKECFLNQTDETLSNVE corresponding to amino acids 1-78 of MGBA_HUMAN (SEQ ID NO:1416), which also corresponds to amino acids 1-78 of HSU33147_PEA__1_P5 (SEQ ID NO:1415), and a second amino acid sequence being at least 90% homologous to QLIYDSSLCDLF corresponding to amino acids 82-93 of MGBA_HUMAN (SEQ ID NO:1416), which also corresponds to amino acids 79-90 of HSU33147_PEA__1_P5 (SEQ ID NO:1415), wherein said first amino acid sequence and second amino acid sequence are contiguous and in a sequential order.

According to preferred embodiments of the present invention, there is provided an isolated chimeric polypeptide encoding for an edge portion of HSU33147_PEA__1_P5 (SEQ ID NO:1415), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EQ, having a structure as follows: a sequence starting from any of amino acid numbers 78−x to 78; and ending at any of amino acid numbers 79+((n−2)−x), in which x varies from 0 to n−2.

According to preferred embodiments of the present invention, there is provided an isolated chimeric polypeptide encoding for HSU33147_PEA__1_P5 (SEQ ID NO:1415), comprising a first amino acid sequence being at least 90% homologous to MKLLMVLMLAALSQHCYAGSGCPL-LENVISKTINPQVSKTEYKELLQEFIDDNATTNAI DELKECFLNQTDETLSNVE corresponding to amino acids 1-78 of MGBA_HUMAN (SEQ ID NO:1416), which also corresponds to amino acids 1-78 of HSU33147_PEA__1_P5 (SEQ ID NO:1415), and a second amino acid sequence being at least 90% homologous to QLIYDSSLCDLF corresponding to amino acids 82-93 of MGBA_HUMAN (SEQ ID NO:1416), which also corresponds to amino acids 79-90 of HSU33147_PEA_1_P5 (SEQ ID NO:1415), wherein said first amino acid sequence and second amino acid sequence are contiguous and in a sequential order.

According to preferred embodiments of the present invention, there is provided an isolated chimeric polypeptide encoding for an edge portion of HSU33147_PEA_1_P5 (SEQ ID NO:1415), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EQ, having a structure as follows: a sequence starting from any of amino acid numbers 78−x to 78; and ending at any of amino acid numbers 79+((n−2)−x), in which x varies from 0 to n−2.

According to preferred embodiments of the present invention, there is provided an isolated chimeric polypeptide encoding for M78076_PEA_1_P3 (SEQ ID NO:1350), comprising a first amino acid sequence being at least 90% homologous to MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGV DIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKD corresponding to amino acids 1-517 of APP1_HUMAN (SEQ ID NO:1439), which also corresponds to amino acids 1-517 of M78076_PEA_1_P3 (SEQ ID NO:1350), and a second amino acid sequence being at least 70%, optionally at least 80%, preferably at least 85%, more preferably at least 90% and most preferably at least 95% homologous to a polypeptide having the sequence GE corresponding to amino acids 518-519 of M78076_PEA_1_P3 (SEQ ID NO:1350), wherein said first amino acid sequence and second amino acid sequence are contiguous and in a sequential order.

According to preferred embodiments of the present invention, there is provided an isolated chimeric polypeptide encoding for M78076_PEA_1_P4 (SEQ ID NO:1351), comprising a first amino acid sequence being at least 90% homologous to MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGV DIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKG corresponding to amino acids 1-526 of APP1_HUMAN (SEQ ID NO:1439), which also corresponds to amino acids 1-526 of M78076_PEA_1_P4 (SEQ ID NO:1351), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:1718) corresponding to amino acids 527-541 of M78076_PEA_1P4 (SEQ ID NO:1351), wherein said first amino acid sequence and second amino acid sequence are contiguous and in a sequential order.

According to preferred embodiments of the present invention, there is provided an isolated polypeptide encoding for a tail of M78076_PEA_1_P4 (SEQ ID NO:1351), comprising a polypeptide being at least 70%, optionally at least about 80%, preferably at least about 85%, more preferably at least about 90% and most preferably at least about 95% homologous to the sequence ECLTVNPSLQIPLNP (SEQ ID NO:1718) in M78076_PEA_1_P4 (SEQ ID NO:1351).

According to preferred embodiments of the present invention, there is provided an isolated chimeric polypeptide encoding for M78076_PEA_1_P12 (SEQ ID NO:1352), comprising a first amino acid sequence being at least 90% homologous to MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGV DIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKG corresponding to amino acids 1-526 of APP1_HUMAN (SEQ ID NO:1439), which also corresponds to amino acids 1-526 of M78076_PEA_1_P12 (SEQ ID NO:1352), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:1719) corresponding to amino acids 527-544 of M78076_PEA_1_P12 (SEQ ID NO:1352), wherein said first amino acid sequence and second amino acid sequence are contiguous and in a sequential order.

According to preferred embodiments of the present invention, there is provided an isolated polypeptide encoding for a tail of M78076_PEA_1_P12 (SEQ ID NO:1352), comprising a polypeptide being at least 70%, optionally at least about 80%, preferably at least about 85%, more preferably at least about 90% and most preferably at least about 95% homologous to the sequence ECVCSKGFPFPLIGDSEG (SEQ ID NO:1719) in M78076PEA_1_P12 (SEQ ID NO:1352).

According to preferred embodiments of the present invention, there is provided an isolated chimeric polypeptide encoding for M78076_PEA_1_P14 (SEQ ID NO:1353), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIYFGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKDDTPMTLPKGST EQDAASPEKEKMNPLEQYERKVNAS-VPRGFPFHSSEIQRDEL corresponding to amino acids 1-570 of APP1_HUMAN (SEQ ID NO:1439), which also corresponds to amino acids 1-570 of M78076_PEA_1_P14 (SEQ ID NO:1353), and a second amino acid sequence being at least 70%, optionally at least 80%, preferably at least 85%, more preferably at least 90% and most preferably at least 95% homologous to a polypeptide having the sequence VRGG-TAGYLGEETRGQRPGCDSQSHTGPSKKP-SAPSPLPAGTSWDRGVP (SEQ ID NO: 1720) corresponding to amino acids 571-619 of M78076_PEA_1_P14 (SEQ ID NO:1353), wherein said first amino acid sequence and second amino acid sequence are contiguous and in a sequential order.

According to preferred embodiments of the present invention, there is provided an isolated polypeptide encoding for a tail of M78076_PEA_1_P14 (SEQ ID NO:1353), comprising a polypeptide being at least 70%, optionally at least about 80%, preferably at least about 85%, more preferably at least about 90% and most preferably at least about 95% homologous to the sequence VRGGTAGYLGEETRGQRPGCD-SQSHTGPSKKPSAPSPLPAGTSWDRGVP (SEQ ID NO: 1720) in M78076_PEA_1_P14 (SEQ ID NO:1353).

According to preferred embodiments of the present invention, there is provided an isolated chimeric polypeptide encoding for M78076_PEA_1_P21 (SEQ ID NO:1354), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIYFGMPGEISEHEGFLRAKMDLEERRMR-QINEVMREWAMADNQSKNLPKADRQALN E corresponding to amino acids 1-352 of APP1_HUMAN (SEQ ID NO:1439), which also corresponds to amino acids 1-352 of M78076_PEA_1_P21 (SEQ ID NO:1354), and a second amino acid sequence being at least 90% homologous to AERVLLALRRYLRAEQKEQRHTLRHYQH-VAAVDPEKAQQMRFQVHTHLQVIEERVNQ SLGLL-DQNPHLAQELRPQIQELLHSEHLGPSE-LEAPAPGGSSEDKGGLQPPDSKDDTPMT LPKGSTEQDAASPEKEKMNPLEQYERKV-NASVPRGFPFHSSEIQRDELAPAGTGVSREA VSGLLIMGAGGGSLIVLSMLLLR-RKKPYGAISHGVVEVDPMLTLEEQQLRELQRHGYE NPTYRFLEERP corresponding to amino acids 406-650 of APP1_HUMAN (SEQ ID NO:1439), which also corresponds to amino acids 353-597 of M78076_PEA_1_P21 (SEQ ID NO:1354), wherein said first amino acid sequence and second amino acid sequence are contiguous and in a sequential order.

According to preferred embodiments of the present invention, there is provided an isolated chimeric polypeptide encoding for an edge portion of M78076_PEA_1_P21 (SEQ ID NO:1354), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352−x to 352; and ending at any of amino acid numbers 353+((n−2)−x), in which x varies from 0 to n−2.

According to preferred embodiments of the present invention, there is provided an isolated chimeric polypeptide encoding for M78076_PEA_1_P24 (SEQ ID NO:1355), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIYFGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQI corresponding to amino acids 1-481 of APP1_HUMAN (SEQ ID NO:1439), which also corresponds to amino acids 1-481 of M78076_PEA_1_P24 (SEQ ID NO:1355), and a second amino acid sequence being at least 70%, optionally at least 80%, preferably at least 85%, more preferably at least 90% and most preferably at least 95% homologous to a polypeptide having the sequence RECLL-PWLPLQISEGRS (SEQ ID NO: 1721) corresponding to amino acids 482-498 of M78076_PEA_1_P24 (SEQ ID NO:1355), wherein said first amino acid sequence and second amino acid sequence are contiguous and in a sequential order.

According to preferred embodiments of the present invention, there is provided an isolated polypeptide encoding for a tail of M78076_PEA_1_P24 (SEQ ID NO:1355), comprising a polypeptide being at least 70%, optionally at least about 80%, preferably at least about 85%, more preferably at least about 90% and most preferably at least about 95% homologous to the sequence RECLLPWLPLQISEGRS (SEQ ID NO:1721) in M78076_PEA_1_P24 (SEQ ID NO:1355).

According to preferred embodiments of the present invention, there is provided an isolated chimeric polypeptide encoding for M78076_PEA_1_P2 (SEQ ID NO:1356), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-
PQRVLEYCRQMYPELQIARVEQATQAIPME
RWCGGSRSGSCAHPHHQVVPFR-
CLPGEFVSEALLVPEGCRFLHQERMDQCESSTRRHQ
EAQEACSSQGLILHGSGMLLPCGS-
DRFRGVEYVCCPPPGTPDPSGTAVGDPSTRSWPPG
SRVEGAEDEEEEESFPQPVDDYFVEP-
PQAEEEEETVPPPSSHTLAVVGKVTPTPRPTDGV DIY-
FGMPGEISEHEGFLRAKMDLEERRMR-
QINEVMREWAMADNQSKNLPKADRQALN
EHFQSILQTLEEQVSGERQRLVETHA-
TRVIALINDQRRAALEGFLAALQADPPQAERVLL
ALRRYLRAEQKEQRHTLRHYQHVAAVD-
PEKAQQMRFQV corresponding to amino acids 1-449 of
APP1_HUMAN (SEQ ID NO:1439), which also corresponds
to amino acids 1-449 of M78076_PEA_1_P2 (SEQ ID
NO:1356), and a second amino acid sequence being at least
70%, optionally at least 80%, preferably at least 85%, more
preferably at least 90% and most preferably at least 95%
homologous to a polypeptide having the sequence LTSFQLP-
NAPLFLRRPRLRLFSCPLDPLS-
VSWTPSYPLNTASLPLPSLSAQLPDPETWTLT CCVFD-
PCFLALGFLLPPPSILCSVPWIFTAFPRIVFFFFFFLRQ
VLALSPRQESSVRSWLIAT STSWVQAILLPQPLE (SEQ
ID NO:1722) corresponding to amino acids 450-588 of
M78076_PEA_1_P2 (SEQ ID NO:1356), wherein said first
amino acid sequence and second amino acid sequence are
contiguous and in a sequential order.

According to preferred embodiments of the present invention, there is provided an isolated polypeptide encoding for a tail of M78076_PEA_1_P2 (SEQ ID NO:1356), comprising a polypeptide being at least 70%, optionally at least about 80%, preferably at least about 85%, more preferably at least about 90% and most preferably at least about 95% homologous to the sequence LTSFQLPNAPLFLRRPRLRLFSC-PLDPLSVSWTPSYPLNTASLPLPSLSAQLPDPETWTLT CCVFDPCFLALGFLLPPPSILCSVP-
WIFTAFPRIVFFFFFFLRQVLALSPRQESSVRSWLIAT
STSWVQAILLPQPLE (SEQ ID NO:1722) in
M78076_PEA_1_P2 (SEQ ID NO:1356).

According to preferred embodiments of the present invention, there is provided an isolated chimeric polypeptide encoding for M78076_PEA_1_P25 (SEQ ID NO:1357), comprising a first amino acid sequence being at least 90% homologous to MGPASPAARGLSRRPGQPPLPLLL-
PLLLLLLRAQPAIGSLAGGSPGAAEAPGSAQVAGL
CGRLTLHRDLRTGRWEPDPQRSRRCLRD-
PQRVLEYCRQMYPELQIARVEQATQAIPME
RWCGGSRSGSCAHPHHQVVPFR-
CLPGEFVSEALLVPEGCRFLHQERMDQCESSTRRHQ
EAQEACSSQGLILHGSGMLLPCGS-
DRFRGVEYVCCPPPGTPDPSGTAVGDPSTRSWPPG
SRVEGAEDEEEEESFPQPVDDYFVEP-
PQAEEEEETVPPPSSHTLAVVGKVTPTPRPTDGV DIY-
FGMPGEISEHEGFLRAKMDLEERRMR-
QINEVMREWAMADNQSKNLPKADRQALN
EHFQSILQTLEEQVSGERQRLVETHA-
TRVIALINDQRRAALEGFLAALQADPPQAERVLL
ALRRYLRAEQKEQRHTLRHYQHVAAVD-
PEKAQQMRFQ corresponding to amino acids 1-448 of
APP1_HUMAN (SEQ ID NO:1439), which also corresponds
to amino acids 1-448 of M78076_PEA_1_P25 (SEQ ID
NO:1357), and a second amino acid sequence being at least
70%, optionally at least 80%, preferably at least 85%, more
preferably at least 90% and most preferably at least 95%
homologous to a polypeptide having the sequence PQNPN-
SQPRAAGSLEVIISHPFVRRLEIL-
ISPFQFQNSIPKNSQIVPAASPRGTSSP (SEQ ID
NO:1723) corresponding to amino acids 449-505 of
M78076_PEA_1_P25 (SEQ ID NO:1357), wherein said first
amino acid sequence and second amino acid sequence are
contiguous and in a sequential order.

According to preferred embodiments of the present invention, there is provided an isolated polypeptide encoding for a tail of M78076_PEA_1_P25 (SEQ ID NO:1357), comprising a polypeptide being at least 70%, optionally at least about 80%, preferably at least about 85%, more preferably at least about 90% and most preferably at least about 95% homologous to the sequence PQNPNSQPRAAGSLEVIISHPFVR-
RLEILISPFQFQNSIPKNSQIVPAASPRGTSSP (SEQ ID
NO:1723) in M78076_PEA_1_P25 (SEQ ID NO:1357).

According to preferred embodiments of the present invention, there is provided an isolated chimeric polypeptide encoding for M79217_PEA_1_P1 (SEQ ID NO:1336), comprising a first amino acid sequence being at least 90% homologous to MTGYTMLRNGGAGNGGQTCMLRWS-
NRIRLTWLSFTLFVILVFFPLIAHYYLTTLDEAD
EAGKRIFGPRVGNELCEVKHVLDLCR-
IRESVSEELLQLEAKRQELNSEIAKLNLKIEACK
KSIENAKQDLLQLKNVISQTEHSYKEL-
MAQNQPKLSLPIRLLPEKDDAGLPPPKATRGC
RLHNCFDYSRCPLTSGFPVYVYDS-
DQFVFGSYLDPLVKQAFQATARANVYVTENADIA
CLYVILVGEMQEPVVLRPAELEKQLYSL-
PHWRTDGHNHVIINLSRKSDTQNLLYNVSTG RAM-
VAQSTFYTVQYRPGFDLVVSPLVHAM-
SEPNFMEIPPQVPVKRKYLFTFQGEKIESL
RSSLQEARSFEEEMEGDPPADYDDRII-
ATLKAVQDSKLDQVLVEFTCKNQPKPSLPTEW
ALCGEREDRLELLKLSTFALIITPGD-
PRLVISSGCATRLFEALEVGAVPVVLGEQVQLPY
QDMLQWNEAALVVPKPRVTEVHFLL-
RSLSDSDLLAMRRQGRFLWETYFSTADSIFNTV
LAMIRTRIQIPAAPIREEAAAEIPHRSG-
KAAGTDPNMADNGDLDLGPVETEPPYASPRYL
RNFTLTVTDFYRSWNCAPGPFHLFPHT-
PFDPVLPSEAKFLGSGTGFRPIGGGAGGSGKEF
QAALGGNVPREQFTVVMLTYEREEV-
LMNSLERLNGLPYLNKVVVVWNSPKLPSEDLL
WPDIGVPIMVVRTEKNSLNNRFLPWNEI-
ETEAILSIDDDAHLRHDEIMFGFRVWREARD RIVGF-
PGRYHAWDIPHQSWLYNSNYSCELSMV-
LTGAAFFHKYYAYLYSYVMPQAIRD
MVDEYINCEDIAMNFLVSHITRKP-
PIKVTSRWTFRCPGCPQALSHDDSHFHERHKCINFF
VKVYGYMPLLYTQFRVDSVLFKTRLPHDKTKCFKFI
corresponding to amino acids 13-931 of BAA25445 (SEQ ID
NO:1437), which also corresponds to amino acids 1-919 of
M79217_PEA_1_P1 (SEQ ID NO:1336).

According to preferred embodiments of the present invention, there is provided an isolated chimeric polypeptide encoding for M79217_PEA_1_P2 (SEQ ID NO:1337), comprising a first amino acid sequence being at least 90% homologous to MTGYTMLRNGGAGNGGQTCMLRWS-
NRIRLTWLSFTLFVILVFFPLIAHYYLTTLDEAD
EAGKRIFGPRVGNELCEVKHVLDLCR-
IRESVSEELLQLEAKRQELNSEIAKLNLKIEACK
KSIENAKQDLLQLKNVISQTEHSYKEL-
MAQNQPKLSLPIRLLPEKDDAGLPPPKATRGC
RLHNCFDYSRCPLTSGFPVYVYDS-
DQFVFGSYLDPLVKQAFQATARANVYVTENADIA
CLYVILVGEMQEPVVLRPAELEKQLYSL-
PHWRTDGHNHVIINLSRKSDTQNLLYNVSTG RAM-
VAQSTFYTVQYRPGFDLVVSPLVHAM- SEPNFMEIPPQVPVKRKYLFTFQGEKIESL RSSLQEARSFEEEMEGDPPADYDDRII-ATLKAVQDSKLDQVLVEFTCKNQPKPSLPTEW ALCGEREDRLELLKLSTFALIITPGD-PRLVISSGCATRLFEALEVGAVPVVLGEQVQLPY QDMLQWNEAALVVPKPRVTEVHFLL-RSLSDSDLLAMRRQGRFLWETYFSTADSIFNTV LAMIRTRIQIPAAPIREEAAAEIPHRSG-KAAGTDPNMADNGDLDLGPVETEPPYASPRYL RNFTLTVTDFYRSWNCAPGPFHLFPHT-PFDPVLPSEAKFLGSGTGFRPIGGGAGGSGKEF QAALGGNVPREQFTVVMLTYEREEV-LMNSLERLNGLPYLNKVVVVWNSPKLPSEDLL WPDIGVPIMVVRTEKNSLNNRFLPWNEI-ETEAILSIDDDAHLRHDEIMFGFRVWREARD RIVGF-PGRYHAWDIPHQSWLYNSNYSCELSMVLTGAAFFHK corresponding to amino acids 1-807 of EXL3_HUMAN (SEQ ID NO:1436), which also corresponds to amino acids 1-807 of M79217_PEA_1_P2 (SEQ ID NO:1337), and a second amino acid sequence being at least 90% homologous to AIRDMVDEYINCEDIAMNFLVSHITRKP-PIKVTSRWTFRCPGCPQALSHDDSHFHERHK CIN-FFVKVYGYMPLLYTQFRVDSVLFKTRL-PHDKTKCFKFI corresponding to amino acids 820-919 of EXL3_HUMAN (SEQ ID NO:1436), which also corresponds to amino acids 808-907 of M79217_PEA_1_P2 (SEQ ID NO:1337), wherein said first amino acid sequence and second amino acid sequence are contiguous and in a sequential order.

According to preferred embodiments of the present invention, there is provided an isolated chimeric polypeptide encoding for an edge portion of M79217_PEA_1_P2 (SEQ ID NO:1337), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KA, having a structure as follows: a sequence starting from any of amino acid numbers 807−x to 807; and ending at any of amino acid numbers 808+((n−2)−x), in which x varies from 0 to n−2.

According to preferred embodiments of the present invention, there is provided an isolated chimeric polypeptide encoding for M79217_PEA_1_P4 (SEQ ID NO:1338), comprising a first amino acid sequence being at least 70%, optionally at least 80%, preferably at least 85%, more preferably at least 90% and most preferably at least 95% homologous to a polypeptide having the sequence PELRQPAR-LGLPECWDYRHEPRCPAQMGSHFIVQA-GLKLLASSKPPKCWDY (SEQ ID NO:1724) corresponding to amino acids 1-51 of M79217_PEA_1_P4 (SEQ ID NO:1338), and a second amino acid sequence being at least 90% homologous to RVWREARDRIVGFPGRYHAWD-IPHQSWLYNSNYSCELSMVLTGAAFFHKYYAYLYSY VMPQAIRDMVDEYINCEDIAMN-FLVSHITRKPPIKVTSRWTFRCPGCPQALSHDDSHFH ERHKCINFFVKVYGYMPLLYTQFRVDSV-LFKTRLPHDKTKCFKFI corresponding to amino acids 759-919 of EXL3_HUMAN (SEQ ID NO:1436), which also corresponds to amino acids 52-212 of M79217_PEA_1_P4 (SEQ ID NO:1338), wherein said first amino acid sequence and second amino acid sequence are contiguous and in a sequential order.

According to preferred embodiments of the present invention, there is provided an isolated polypeptide encoding for a head of M79217_PEA_1_P4 (SEQ ID NO:1338), comprising a polypeptide being at least 70%, optionally at least about 80%, preferably at least about 85%, more preferably at least about 90% and most preferably at least about 95% homologous to the sequence PELRQPARLGLPECWDYRHEPRC-PAQMGSHFIVQAGLKLLASSKPPKCWDY (SEQ ID NO:1724) of M79217_PEA_1_P4 (SEQ ID NO:1338).

According to preferred embodiments of the present invention, there is provided an isolated chimeric polypeptide encoding for M79217_PEA_1_P8 (SEQ ID NO:1339), comprising a first amino acid sequence being at least 90% homologous to MTGYTMLRNGGAGNGGQTCMLRWS-NRIRLTWLSFTLFVILVFFPLIAHYYLTTLDEAD EAGKRIFGPRVGNELCEVKHVLDLCR-IRESVSEELLQLEAKRQELNSEIAKLNLKIEACK KSIENAKQDLLQLKNVISQTEHSYKEL-MAQNQPKLSLPIRLLPEKDDAGLPPPKATRGC RLHNCFDYSRCPLTSGFPVYVYDS-DQFVFGSYLDPLVKQAFQATARANVYVTENADIA CLYVILVGEMQEPVVLRPAELEKQLYSL-PHWRTDGHNHVIINLSRKSDTQNLLYNVSTG RAM-VAQSTFYTVQYRPGFDLVVSPLVHAM-SEPNFMEIPPQVPVKRKYLFTFQGEKIESL RSSLQEARSFEEEMEGDPPADYDDRII-ATLKAVQDSKLDQVLVEFTCKNQPKPSLPTEW ALCGEREDRLELLKLSTFALIITPGD-PRLVISSGCATRLFEALEVGAVPVVLGEQVQLPY QDMLQWNEAALVVPKPRVTEVHFLL-RSLSDSDLLAMRRQGRFLWETYFSTADSIFNTV LAMIRTRIQIPAAPIREEAAAEIPHRSG-KAAGTDPNMADNGDLDLGPVETEPPYASPRYL RNFTLTVTDFYRSWNCAPGPFHLFPHT-PFDPVLPSEAKFLGSGTGFRPIGGGAGGSGKEF QAALGGNVPREQFTVVMLTYEREEV-LMNSLERLNGLPYLNKVVVVWNSPKLPSEDLL WPDIGVPIMVVRTEKNSLNNRFLPWNEI-ETEAILSIDDDAHLRHDEIMFGFRVWREARD RIVGF-PGRYHAWDIPHQSWLYNSNYSCELSMVLTGAAFFHK corresponding to amino acids 1-807 of EXL3_HUMAN (SEQ ID NO:1436), which also corresponds to amino acids 1-807 of M79217_PEA_1_P8 (SEQ ID NO:1339), and a second amino acid sequence being at least 70%, optionally at least 80%, preferably at least 85%, more preferably at least 90% and most preferably at least 95% homologous to a polypeptide having the sequence VRKSW (SEQ ID NO:1725) corresponding to amino acids 808-812 of M79217_PEA_1_P8 (SEQ ID NO:1339), wherein said first amino acid sequence and second amino acid sequence are contiguous and in a sequential order.

According to preferred embodiments of the present invention, there is provided an isolated polypeptide encoding for a tail of M79217_PEA_1_P8 (SEQ ID NO:1339), comprising a polypeptide being at least 70%, optionally at least about 80%, preferably at least about 85%, more preferably at least about 90% and most preferably at least about 95% homologous to the sequence VRKSW (SEQ ID NO:1725) in M79217_PEA_1_P8 (SEQ ID NO:1339).

According to preferred embodiments of the present invention, there is provided an isolated chimeric polypeptide encoding for M62096_PEA_1_P4 (SEQ ID NO:1341), comprising a first amino acid sequence being at least 70%, optionally at least 80%, preferably at least 85%, more preferably at least 90% and most preferably at least 95% homologous to a polypeptide having the sequence MATYIH (SEQ ID NO:1726) corresponding to amino acids 1-6 of M62096_PEA_1_P4 (SEQ ID NO:1341), and a second amino acid sequence being at least 90% homologous to VSK-TGAEGAVLDEAKNINKSLSALGNVIS- ALAEGTKTHVPYRDSKMTRILQDSLGGNC RTTIVICCSPSVFNEAETKSTLMFGQRAKTIKNTVSVNLELTAEEWKKKYEKEKEKNKT LKNVIQHLEMELNRWRNGEAVPEDEQISAKDQKNLEPCDNTPIIDNIAPVVAGISTEEKE KYDEEISSLYRQLDDKDDEINQQSQLAEKLKQQMLDQDELLASTRRDYEKIQ EELTRLQ IENEAAKDEVKEVLQALEELAVNYDQKSQEVEDKTRANEQLTDELAQKTTTLTTTQRE LSQLQELSNHQKKRATEILNLLLKDLGEIGGIIGTNDVKTLADVNGVIEEEFTMARLYIS KMKSEVKSLVNRSKQLESAQMDSNRKMNASERELAACQLLISQHEAKIKSLTD YMQN MEQKRRQLEESQDSLSEELAKLRAQEKMHEVSFQDKEKEHLTRLQDAEEMKKALEQQ MESHREAHQKQLSRLRDEIEEKQKIIDEIRDLNQKLQLEQEKLSSDYNKLKIEDQEREM KLEKLLLLNDKREQAREDLKGLEETVSRELQTLHNLRKLFVQDLTTRVKKSVELDNDD GGGSAAQKQKISFLENNLEQLTKVHKQLVRDNADLRCELPKLEKRLRATAERVKALES ALKEAKENAMRDRKRYQQEVDRIKEAVRAKNMARRAHSAQIAKPIRPGHYPASSPTA VHAIRGGGGSSSNSTHYQK corresponding to amino acids 239-957 of KF5C_HUMAN (SEQ ID NO:1438), which also corresponds to amino acids 7-725 of M62096_PEA__1_P4 (SEQ ID NO:1341), wherein said first amino acid sequence and second amino acid sequence are contiguous and in a sequential order.

According to preferred embodiments of the present invention, there is provided an isolated polypeptide encoding for a head of M62096_PEA__1_P4 (SEQ ID NO:1341), comprising a polypeptide being at least 70%, optionally at least about 80%, preferably at least about 85%, more preferably at least about 90% and most preferably at least about 95% homologous to the sequence MATYIH (SEQ ID NO:1726) of M62096_PEA__1_P4 (SEQ ID NO:1341).

According to preferred embodiments of the present invention, there is provided an isolated chimeric polypeptide encoding for M62096_PEA__1_P5 (SEQ ID NO:1342), comprising a first amino acid sequence being at least 90% homologous to MTRILQDSLGGNCRTTIVICCSPSVFNEAETKSTLMFGQRAKTIKNTVSVNLELTAEEWK KYEKEKEKNKTLKNVIQHLEMELNRWRNGEAVPEDEQISAKDQKNLEPCDNTPIIDNI APVVAGISTEEKEKYDEEISSLYRQLDDKDDEINQQSQLAEKLKQQMLDQDELLASTRR DYEKIQEELTRLQIENEAAKDEVKEVLQALEELAVNYDQKSQEVEDKTRANEQLTDEL AQKTTTLTTTQRELSQLQELSNHQKKRATEILNLLLKDLGEIGGIIGTNDVKTLADVNG VIEEEFTMARLYISKMKSEVKSLVNRSKQLESAQMDSNRKMNASERELAACQLLISQHE AKIKSLTDYMQNMEQKRRQLEESQDSLSEELAKLRAQEKMHEVSFQDKEKEHLTRLQ DAEEMKKALEQQMESHREAHQKQLSRLRDEIEEKQKIIDEIRDLNQKLQLEQEKLSSDY NKLKIEDQEREMKLEKLLLLNDKREQAREDLKGLEETVSRELQTLHNLRKLFVQDLTT RVKKSVELDNDDGGGSAAQKQKISFLENNLEQLTKVHKQLVRDNADLRCELPKLEKRL RATAERVKALESALKEAKENAMRDRKRYQQEVDRIKEAVRAKNMARRAHSAQIAKPI RPGHYPASSPTAVHAIRGGGGSSSNSTHYQK corresponding to amino acids 284-957 of KF5C_HUMAN (SEQ ID NO:1438), which also corresponds to amino acids 1-674 of M62096_PEA__1_P5 (SEQ ID NO:1342).

According to preferred embodiments of the present invention, there is provided an isolated chimeric polypeptide encoding for M62096_PEA__1_P3 (SEQ ID NO:1343), comprising a first amino acid sequence being at least 90% homologous to MELNRWRNGEAVPEDEQISAKDQKNLEPCDNTPIIDNIAPVVAGISTEEKEKYDEEISSL YRQLDDKDDEINQQSQLAEKLKQQMLDQDELLASTRRDYEKIQEELTRLQIENEAAKD EVKEVLQALEELAVNYDQKSQEVEDKTRANEQLTDELAQKTTTLTTTQRELSQLQELS NHQKKRATEILNLLLKDLGEIGGIIGTNDVKTLADVNGVIEEEFTMARLYISKMKSEVKS LVNRSKQLESAQMDSNRKMNASERELAACQLLISQHEAKIKSLTDYMQNMEQKRRQL EESQDSLSEELAKLRAQEKMHEVSFQDKEKEHLTRLQDAEEMKKALEQQMESHREAH QKQLSRLRDEIEEKQKIIDEIRDLNQKLQLEQEKLSSDYNKLKIEDQEREMKLEKLLLLN DKREQAREDLKGLEETVSRELQTLHNLRKLFVQDLTTRVKKSVELDNDDGGGSAAQK QKISFLENNLEQLTKVHKQLVRDNADLRCELPKLEKRLRATAERVKALESALKEAKEN AMRDRKRYQQEVDRIKEAVRAKNMARRAHSAQIAKPIRPGHYPASSPTAVHAIRGGGG SSSNSTHYQK corresponding to amino acids 365-957 of KF5C_HUMAN (SEQ ID NO:1438), which also corresponds to amino acids 1-593 of M62096_PEA__1_P3 (SEQ ID NO:1343).

According to preferred embodiments of the present invention, there is provided an isolated chimeric polypeptide encoding for M62096_PEA__1_P7 (SEQ ID NO:1344), comprising a first amino acid sequence being at least 70%, optionally at least 80%, preferably at least 85%, more preferably at least 90% and most preferably at least 95% homologous to a polypeptide having the sequence MTQNFRLMWNILLFPLNFS (SEQ ID NO:1727) corresponding to amino acids 1-19 of M62096_PEA__1_P7 (SEQ ID NO:1344), and a second amino acid sequence being at least 90% homologous to LNQKLQLEQEKLSSDYNKLKIEDQEREMKLEKLLLLNDKREQAREDLKGLEETVSREL QTLHNLRKLFVQDLTTRVKKSVELDNDDGGGSAAQKQKISFLENNLEQLTKVHKQLVR DNADLRCELPKLEKRLRATAERVKALESALKEAKENAMRDRKRYQQEVDRIKEAVRA KNMARRAHSAQIAKPIRPGHYPASSPTAVHAIRGGGGSSSNSTHYQK corresponding to amino acids 738-957 of KF5C_HUMAN (SEQ ID NO:1438), which also corresponds to amino acids 20-239 of M62096_PEA__1_P7 (SEQ ID NO:1344), wherein said first amino acid sequence and second amino acid sequence are contiguous and in a sequential order.

According to preferred embodiments of the present invention, there is provided an isolated polypeptide encoding for a head of M62096_PEA__1_P7 (SEQ ID NO:1344), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO:1727) of M62096_PEA__1_P7 (SEQ ID NO:1344).

According to preferred embodiments of the present invention, there is provided an isolated chimeric polypeptide encoding for M62096_PEA__1_P8 (SEQ ID NO:1345), comprising a first amino acid sequence being at least 90% homologous to MADPAECSIKVMCRFRPLNEAEILRGD-KFIPKFKGDETVVIGQGKPYVFDRVLPPNTTQ EQVYNACAKQIVKDVLEGYNGTI-FAYGQTSSGKTHTMEGKLHDPQLMGIIPRIAHDIFD HIYSMDENLEFHIKVSYFEIYLD-
KIRDLLDVSKTNLAVHEDKNRVPYVKGCTERFVSSPE
EVMDVIDEGKANRHVAVTNMNEHSSRSH-
SIFLINIKQENVETEKKLSGKLYLVDLAGSE KVSKT-
GAEGAVLDEAKNINKSLSALGNVIS-
ALAEGTKTHVPYRDSKMTRILQDSLGGN
CRTTIVICCSPSVFNEAETKSTLMF-
GQRAKTIKNTVSVNLELTAEEWKKKYEKEKEKNK
TLKNVIQHLEMELNRWRNGEAVPED-
EQISAKDQKNLEPCDNTPIIDNIAPVVAGISTEEK EKY-
DEEISSLYRQLDDKDDEINQQSQLAEK-
LKQQMLDQDELLASTRRDYEKIQEELTRL
QIENEAAKDEVKEVLQALEELAVNYDQK-
SQEVEDKTRANEQLTDELAQKTTTLTTTQR
ELSQLQELSNHQKKRATEILN-
LLLKDLGEIGGIIGTNDVKTLAD-
VNGVIEEEFTMARLYI SKMKSEVKSLVNRSKQLE-
SAQMDSNRKMNASERELAACQLLISQHEAKIKSLTD
YMQN MEQKRRQLEESQDSLSEELAKLRAQEKM-
HEVSFQDKEKEHLTRLQDAEEMKKALEQQ
MESHREAHQKQLSRLRDEIEEKQKIIDEIR corresponding to amino acids 1-736 of KF5C_HUMAN (SEQ ID NO:1438), which also corresponds to amino acids 1-736 of M62096_PEA_1_P8 (SEQ ID NO:1345), and a second amino acid sequence being at least 70%, optionally at least 80%, preferably at least 85%, more preferably at least 90% and most preferably at least 95% homologous to a polypeptide having the sequence E corresponding to amino acids 737-737 of M62096_PEA_1_P8 (SEQ ID NO:1345), wherein said first amino acid sequence and second amino acid sequence are contiguous and in a sequential order.

According to preferred embodiments of the present invention, there is provided an isolated chimeric polypeptide encoding for M62096_PEA_1_P9 (SEQ ID NO:1346), comprising a first amino acid sequence being at least 90% homologous to MADPAECSIKVMCRFRPLNEAEILRGD-
KFIPKFKGDETVVIGQGKPYVFDRVLPPNTTQ
EQVYNACAKQIVKDVLEGYNGTI-
FAYGQTSSGKTHTMEGKLHDPQLMGIIPRIAHDIFD
HIYSMDENLEFHIKVSYFEIYLD-
KIRDLLDVSKTNLAVHEDKNRVPYVKGCTERFVSSPE
EVMDVIDEGKANRHVAVTNMNEHSSRSH-
SIFLINIKQENVETEKKLSGKLYLVDLAGSE KVSKT-
GAEGAVLDEAKNINKSLSALGNVIS-
ALAEGTKTHVPYRDSKMTRILQDSLGGN
CRTTIVICCSPSVFNEAETKSTLMF-
GQRAKTIKNTVSVNLELTAEEWKKKYEKEKEKNK
TLKNVIQHLEMELNRWRNGEAVPED-
EQISAKDQKNLEPCDNTPIIDNIAPVVAGISTEEK EKY-
DEEISSLYRQLDDKDDEINQQSQLAEK-
LKQQMLDQDE corresponding to amino acids 1-454 of KF5C_HUMAN (SEQ ID NO:1438), which also corresponds to amino acids 1-454 of M62096_PEA_1_P9 (SEQ ID NO:1346), and a second amino acid sequence being at least 70%, optionally at least 80%, preferably at least 85%, more preferably at least 90% and most preferably at least 95% homologous to a polypeptide having the sequence VKNAIY-
FFFHKVLLLLFVVDVCSRNLIGIEAFH-
NYRIMWKFLGRCPFTASYKLIITEFRK (SEQ ID NO:1728) corresponding to amino acids 455-514 of M62096_PEA_1_P9 (SEQ ID NO:1346), wherein said first amino acid sequence and second amino acid sequence are contiguous and in a sequential order.

According to preferred embodiments of the present invention, there is provided an isolated polypeptide encoding for a tail of M62096_PEA_1_P9 (SEQ ID NO:1346), comprising a polypeptide being at least 70%, optionally at least about 80%, preferably at least about 85%, more preferably at least about 90% and most preferably at least about 95% homologous to the sequence VKNAIYFFFHKVLLLLFVVDVCS-
RNLIGIEAFHNYRIMWKFLGRCPFTASYKLIITEFRK (SEQ ID NO:1728) in M62096_PEA_1_P9 (SEQ ID NO:1346).

According to preferred embodiments of the present invention, there is provided an isolated chimeric polypeptide encoding for M62096_PEA_1_P10 (SEQ ID NO:1347), comprising a first amino acid sequence being at least 70%, optionally at least 80%, preferably at least 85%, more preferably at least 90% and most preferably at least 95% homologous to a polypeptide having the sequence MTQNFRLMW-
NILLFPLNFS (SEQ ID NO:1727) corresponding to amino acids 1-19 of M62096_PEA_1_P10 (SEQ ID NO:1347), a second amino acid sequence being at least 90% homologous to LNQKLQLEQEKLSSDYNKLKIEDQER-
EMKLEKLLLLNDKREQAREDLKGLEETVSREL
QTLHNLRKLFVQDLTTRVKK corresponding to amino acids 738-815 of KF5C_HUMAN (SEQ ID NO:1438), which also corresponds to amino acids 20-97 of M62096_PEA_1_P10 (SEQ ID NO:1347), and a third amino acid sequence being at least 70%, optionally at least 80%, preferably at least 85%, more preferably at least 90% and most preferably at least 95% homologous to a polypeptide having the sequence VSSLCLNGTEKKIKDGREESFS-
VEISLA (SEQ ID NO:1730) corresponding to amino acids 98-125 of M62096_PEA_1_P10 (SEQ ID NO:1347), wherein said first amino acid sequence, second amino acid sequence and third amino acid sequence are contiguous and in a sequential order.

According to preferred embodiments of the present invention, there is provided an isolated polypeptide encoding for a head of M62096_PEA_1_P10 (SEQ ID NO:1347), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO:1727) of M62096_PEA_1_P10 (SEQ ID NO:1347).

According to preferred embodiments of the present invention, there is provided an isolated polypeptide encoding for a tail of M62096_PEA_1_P10 (SEQ ID NO:1347), comprising a polypeptide being at least 70%, optionally at least about 80%, preferably at least about 85%, more preferably at least about 90% and most preferably at least about 95% homologous to the sequence VSSLCLNGTEKKIKDGREESFS-
VEISLA (SEQ ID NO:1730) in M62096_PEA_1_P10 (SEQ ID NO:1347).

According to preferred embodiments of the present invention, there is provided an isolated chimeric polypeptide encoding for M62096_PEA_1_P11 (SEQ ID NO:1348), comprising a first amino acid sequence being at least 90% homologous to MADPAECSIKVMCRFRPLNEAEILRGD-
KFIPKFKGDETVVIGQGKPYVFDRVLPPNTTQ
EQVYNACAKQIVKDVLEGYNGTI-
FAYGQTSSGKTHTMEGKLHDPQLMGIIPRIAHDIFD
HIYSMDENLEFHIKVSYFEIYLD-
KIRDLLDVSKTNLAVHEDKNRVPYVKGCTERFVSSPE
EVMDVIDEGKANRHVAVTNMNEHSSRSH-
SIFLINIKQENVETEKKLSGKLYLVDLAGSE KVSKT-
GAEGAVLDEAKNINKSLSALGNVIS-
ALAEGTKTHVPYRDSKMTRILQDSLGGN
CRTTIVICCSPSVFNEAETKSTLMF-
GQRAKTIKNTVSVNLELTAEEWKKKYEKEKEKNK
TLKNVIQHLEMELNRWRN corresponding to amino acids 1-372 of KF5C_HUMAN (SEQ ID NO:1438), which also corresponds to amino acids 1-372 of M62096_PEA_1_P11

(SEQ ID NO:1348), and a second amino acid sequence being at least 70%, optionally at least 80%, preferably at least 85%, more preferably at least 90% and most preferably at least 95% homologous to a polypeptide having the sequence DFLAAH-VFGKLLE (SEQ ID NO:1731) corresponding to amino acids 373-385 of M62096_PEA_1_P11 (SEQ ID NO:1348), wherein said first amino acid sequence and second amino acid sequence are contiguous and in a sequential order.

According to preferred embodiments of the present invention, there is provided an isolated polypeptide encoding for a tail of M62096_PEA_1_P11 (SEQ ID NO:1348), comprising a polypeptide being at least 70%, optionally at least about 80%, preferably at least about 85%, more preferably at least about 90% and most preferably at least about 95% homologous to the sequence DFLAAHVFGKLLE (SEQ ID NO:1731) in M62096_PEA_1_P11 (SEQ ID NO:1348).

According to preferred embodiments of the present invention, there is provided an isolated chimeric polypeptide encoding for M62096_PEA_1_P12 (SEQ ID NO:1349), comprising a first amino acid sequence being at least 90% homologous to MADPAECSIKVMCRFRPLNEAEILRGD-KFIPKFKGDETVVIGQGKPYVFDRVLPPNTTQ EQVYNACAKQIVKDVLEGYNGTI-FAYGQTSSGKTHTMEGKLHDPQLMGIIPRIAHDIFD HIYSMDENLEFHIKVSYFEIYLD-KIRDLLDVSKTNLAVHEDKNRVPYVKGCTERFVSSPE EVMDVIDEGKANRHVAVTNMNEHSSRSH-SIFLINIKQENVETEKKLSGKLYLVDLAGSE KVSKT-GAEGAVLDEAKNINKSLSALGNVIS-ALAEGTKTHVPYRDSKMTRILQDSLGGN CRTTIVICCSPSVFNEAETKSTLMFGQR corresponding to amino acids 1-323 of KF5C_HUMAN (SEQ ID NO:1438), which also corresponds to amino acids 1-323 of M62096_PEA_1_P12 (SEQ ID NO:1349), and a second amino acid sequence being at least 70%, optionally at least 80%, preferably at least 85%, more preferably at least 90% and most preferably at least 95% homologous to a polypeptide having the sequence V corresponding to amino acids 324-324 of M62096_PEA_1_P12 (SEQ ID NO:1349), wherein said first amino acid sequence and second amino acid sequence are contiguous and in a sequential order.

According to preferred embodiments of the present invention, there is provided an isolated chimeric polypeptide encoding for T99080_PEA_4_P5 (SEQ ID NO:1360), comprising a first amino acid sequence being at least 70%, optionally at least 80%, preferably at least 85%, more preferably at least 90% and most preferably at least 95% homologous to a polypeptide having the sequence MPASARLA-GAGLLLAFLRALGCAGRAPGLS (SEQ ID NO: 1732) corresponding to amino acids 1-30 of T99080_PEA_4_P5 (SEQ ID NO:1360), and a second amino acid sequence being at least 90% homologous to MAEGNTLISVDYEIF-GKVQGVFFRKHTQAEGKKLGLVGWVQNT-DRGTVQGQLQGPIS KVRHMQEWLETRGSPKSHID-KANFNNEKVILKLDYSDFQIVK corresponding to amino acids 1-99 of ACYO_HUMAN_V1 (SEQ ID NO:1441), which also corresponds to amino acids 31-129 of T99080_PEA_4_P5 (SEQ ID NO:1360), wherein said first amino acid sequence and second amino acid sequence are contiguous and in a sequential order.

According to preferred embodiments of the present invention, there is provided an isolated polypeptide encoding for a head of T99080_PEA_4_P5 (SEQ ID NO:1360), comprising a polypeptide being at least 70%, optionally at least about 80%, preferably at least about 85%, more preferably at least about 90% and most preferably at least about 95% homologous to the sequence MPASARLAGAGLLLAFLRALGCA-GRAPGLS (SEQ ID NO: 1732) of T99080_PEA_4_P5 (SEQ ID NO:1360).

According to preferred embodiments of the present invention, there is provided an isolated chimeric polypeptide encoding for T99080_PEA_4_P8 (SEQ ID NO:1361), comprising a first amino acid sequence being at least 70%, optionally at least 80%, preferably at least 85%, more preferably at least 90% and most preferably at least 95% homologous to a polypeptide having the sequence M corresponding to amino acids 1-1 of T99080_PEA_4_P8 (SEQ ID NO:1361), and a second amino acid sequence being at least 90% homologous to QAEGKKLGLVGWVQNTDRGTVQGQLQG-PISKVRHMQEWLETRGSPKSHIDKANFNNE KVILKLDYSDFQIVK corresponding to amino acids 28-99 of ACYO_HUMAN_V1 (SEQ ID NO:1441), which also corresponds to amino acids 2-73 of T99080_PEA_4_P8 (SEQ ID NO:1361), wherein said first amino acid sequence and second amino acid sequence are contiguous and in a sequential order.

According to preferred embodiments of the present invention, there is provided an isolated chimeric polypeptide encoding for T08446_PEA_1_P18 (SEQ ID NO:1370), comprising a first amino acid sequence being at least 90% homologous to MLSLSLCSHLWGPLILSALQARSTD-SLDGPGEGSVQPLPTAGGPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPP-PPEGARAAQMLVPLLLQYLETLSGLVDSNLNC GPV-LTWME corresponding to amino acids 1-185 of SNXQ_HU-MAN (SEQ ID NO:1442), which also corresponds to amino acids 1-185 of T08446_PEA_1_P18 (SEQ ID NO:1370), and a second amino acid sequence being at least 70%, optionally at least 80%, preferably at least 85%, more preferably at least 90% and most preferably at least 95% homologous to a polypeptide having the sequence LDNHGRRLLLSEEA-SLNIPAVAAAHVIKRYTAQAPDELSFE-VGDIVSVIDMPPTEDRSW WRGKRGFQVGFF-PSECVELFTERPGPGLKADADGPPCGIPAPQGISSLTS AVPRPRGKLA GLLRTFMRSRPSRQRLRQRGIL-RQRVFGCDLGEHLSNSGQDVPQVL-RCCSEFIEAHGVV DGIYRLSGVSSNIQRLRHEFD-SERIPELSGPAFLQDIHSVSSLCKLYFRELPNPLLTYQLY GKFSEAMSVPGEEERLVRVHDVIQQLPP-PHYRTLEYLLRHLARMARHSANTSMHARNL AIVWAPNLLRSMELESVGMG-GAAAFREVRVQSVVVEFLLTHVDVLFS-DTFTSAGLDPA GRCLLPRPKSLAGSCPSTRLLTLEE-AQARTQGRLGTPTEPTTPKAPASPAERRKGERGEK QRKPGGSSWKTFFALGRGPSVPRKKPLP-WLGGTRAPPQPSGSRPDTVTLRSAKSEESLS SQAS-GAGLQRLHRLRRPHSSSDAFPVGPAPAG-SCESLSSSSSSESSSSESSSSSSESSAAGL GALSGSPSHRTSAWLDDGDELDFSPPRC-LEGLRGLDFDPLTFRCSSPTPGDPAPPASPAP PAPASA-FPPRVTPQAISPRGPTSPASPAALDIS-EPLAVSVPPAVLELLGAGGAPASATPTP ALSPGRSLRPHLIPLLLRGAEAPLTDAC-QQEMCSKLRGAQGPLGPDMESPLPPPPLSLLR PGGAPPPPPKNPARLMALALAERAQQ-VAEQQSQQECGGTPPASQSPFHRSLSLEVGGEP LGTSGSGPPPNSLAHPGAWVPGPPPYL-PRQQSDGSLLRSQRPMGTSRRGLRGPAQVSAQ LRAGGGGRDAPEAAAQSPCSVPSQVPT-PGFFSPAPRECLPPFLGVPKPGLYPLGPPSFQP SSPA-PVWRSSLGPPAPLDRGENLYYEIGASEG- SPYSGPTRSWSPFRSMPPDRLNASYGM LGQSPPLHRSPDFLLSYPPAPSCFPP-DHLGYSAPQHPARRPTPPEPLYVNLALGPRGPSPA SSSSSSPPAHPRSRSDPGP-PVPRLPQKQRAPWGPRTPHRVPGPWG-PPEPLLLYRAAPPAY GRGGELHRGSLYRNGGQRGE-GAGPPPPYPTPSWSLHSEGQTRSYC (SEQ ID NO:1733) corresponding to amino acids 186-1305 of T08446_PEA__1_P18 (SEQ ID NO:1370), wherein said first amino acid sequence and second amino acid sequence are contiguous and in a sequential order.

According to preferred embodiments of the present invention, there is provided an isolated polypeptide encoding for a tail of T08446_PEA__1_P18 (SEQ ID NO:1370), comprising a polypeptide being at least 70%, optionally at least about 80%, preferably at least about 85%, more preferably at least about 90% and most preferably at least about 95% homologous to the sequence LDNHGRRLLLSEEA-SLNIPAVAAAHVIKRYTAQAPDELSFE-VGDIVSVIDMPPTEDRSW WRGKRGFQVGFFPSECVELFTERPG-PGLKADADGPPCGIPAPQGISSLTSAVPRPRGKLA GLLRTFMRSRPSRQRLRQRGILRQRVF-GCDLGEHLSNSGQDVPQVLRCCSEFIEAHGVV DGIYRLSGVSSNIQRLRHEFD-SERIPELSGPAFLQDIHSVSSLCKLY-FRELPNPLLTYQLY GKFSEAMSVPGEEERLVRVHD-VIQQLPPPHYRTLEYLLRHLARMARHSANTSMHAR NL AIVWAPNLLRSMELESVGMG-GAAAFREVRVQSVVVEFLLTHVDVLFS-DTFTSAGLDPA GRCLLPRPKSLAGSCPSTRLLTLEE-AQARTQGRLGTPTEPTTPKAPASPAERRKGERGEK QRKPGGSSWKTFFALGRGPSVPRKKPLP-WLGGTRAPPQPSGSRPDTVTLRSAKSEESLS SQAS-GAGLQRLHRLRRPHSSSDAFPVGPAPAG-SCESLSSSSSSESSSSESSSSSSESSAAGL GALSGSPSHRTSAWLDDGDELDFSPPRC-LEGLRGLDFDPLTFRCSSPTPGDPAPPASPAP PAPASA-FPPRVTPQAISPRGPTSPASPAALDIS-EPLAVSVPPAVLELLGAGGAPASATPTP ALSPGRSLRPHLIPLLLRGAEAPLTDAC-QQEMCSKLRGAQGPLGPDMESPLPPPPLSLLR PGGAPPPPPKNPARLMALALAERAQQ-VAEQQSQQECGGTPPASQSPFHRSLSLEVGGEP LGTSGSGPPPNSLAHPGAWVPGPPPYL-PRQQSDGSLLRSQRPMGTSRRGLRGPAQVSAQ LRAGGGGRDAPEAAAQSPCSVPSQVPT-PGFFSPAPRECLPPFLGVPKPGLYPLGPPSFQP SSPA-PVWRSSLGPPAPLDRGENLYYEIGASEG-SPYSGPTRSWSPFRSMPPDRLNASYGM LGQSPPLHRSPDFLLSYPPAPSCFPP-DHLGYSAPQHPARRPTPPEPLYVNLALGPRGPSPA SSSSSSPPAHPRSRSDPGP-PVPRLPQKQRAPWGPRTPHRVPGPWG-PPEPLLLYRAAPPAY GRGGELHRGSLYRNGGQRGE-GAGPPPPYPTPSWSLHSEGQTRSYC (SEQ ID NO:1733) in T08446_PEA__1_P18 (SEQ ID NO:1370).

According to preferred embodiments of the present invention, there is provided an isolated chimeric polypeptide encoding for T08446_PEA__1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHL-WGPLILSALQARSTDSLDGPGEGSVQPLPTAGGPSV KGKPGKRLSAPRG PFPRLADCAHFHYENVDF-GHIQLLLSPDREGPSLSGENELVF-GVQVTCQGRSWPVLRSY DDFRSLDAHLHR-CIFDRRFSCLPELPPPPEGARAAQMLVPLLLQYLETL SGLVDSNLNC GPVLTWMELDNHGRRLLLSEEA-SLNIPAVAAAHVIKRYTAQAPDELSFEVGDIVSVIDM PPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSE FIEAHGVVDGIYRLSGVSSNIQRL-RHEFDSERIPELSGPAFLQDIHSVSSLCKLYFRELPNP LLTYQLYGKFSEAMSVPGEEERLVRV (SEQ ID NO:1734) corresponding to amino acids 1-443 of T08446_PEA__1_P18 (SEQ ID NO:1370), a second amino acid sequence being at least 90% homologous to HDVIQQLPPPHYRTLEYLLRHLARMAR-HSANTSMHARNLAIVWAPNLLRSMELESVG MGGAAAFREVRVQSVVVEFLLTHVDV-LFSDTFTSAGLDPAGRCLLPRPKSLAGSCPSTR LLTLEEAQARTQGRLGTPTEPTTPKA-PASPAERRKGERGEKQRKPGGSSWKTFFALGRG PSVPRKKPLPWLGGTRAPPQPSGSRP-DTVTLRSAKSEESLSSQASGAGLQRLHRLRRPHS SSDAFPVGPAPAG-SCESLSSSSSSESSSSESSSSSSESSAA-GLGALSGSPSHRTSAWLDDG DELDFSPPRCLEGLR-GLDFDPLTFRCSSPTPGDPAPPASPAPPAPASAFPPRVT PQAISPRG PTSPASPAALDISEPLAVSVPPAVLELL-GAGGAPASATPTPALSPGRSLRPHLIPLLLRGA EAPLT-DACQQEMCSKLRGAQGPLGPDMESPLPP-PPLSLLRPGGAPPPPPKNPARLMALA LAERAQQVAEQQSQQECGGTPPASQSPF-HRSLSLEVGGEPLGTSGSGPPPNSLAHPGAW VPGPP-PYLPRQQSDGSLLRSQRPMGTSRRGLRG-PAQVSAQLRAGGGGRDAPEAAAQSP CSVPSQVPTPGFFSPAPRECLPPFLGVP-KPGLYPLGPPSFQPSSPAPVWRSSLGPPAPLDR GEN-LYYEIGASEGSPYSG corresponding to amino acids 1-674 of Q9NT23 (SEQ ID NO:1443), which also corresponds to amino acids 444-1117 of T08446_PEA__1_P18 (SEQ ID NO:1370), a bridging amino acid P corresponding to amino acid 1118 of T08446_PEA__1_P18 (SEQ ID NO:1370), and a third amino acid sequence being at least 90% homologous to TRSWSPFRSMPPDRLNASYGMLGQSPPL-HRSPDFLLSYPPAPSCFPPDHLGYSAPQHPAR RPT-PPEPLYVNLALGPRGPSPASSSSSSP-PAHPRSRSDPGPPVPRLPQKQRAPWGPRTPHR VPGPWGPPEPLLLYRAAPPAYGRGGEL-HRGSLYRNGGQRGEGAGPPPPYPTPSWSLHS EGQTRSYC corresponding to amino acids 676-862 of Q9NT23 (SEQ ID NO:1443), which also corresponds to amino acids 1119-1305 of T08446_PEA__1_P18 (SEQ ID NO:1370), wherein said first amino acid sequence, second amino acid sequence, bridging amino acid and third amino acid sequence are contiguous and in a sequential order.

According to preferred embodiments of the present invention, there is provided an isolated polypeptide encoding for a head of T08446_PEA__1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLIL-SALQARSTDSLDGPGEGSVQPLPTAG-GPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPP-PPEGARAAQMLVPLLLQYLETLSGLVDSNLNC GPV- LTWMELDNHGRRLLLSEEASLNIPAVAAAHVIKRYTAQAPDELSFEVGDIVSVIDMPPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSEFIEAHGVVDGIYRLSGVSSNIQRL-RHEFDSERIPELSGPAFLQDIHSVSSLCKLYFRELPNPLLTYQLYGKFSEAMSVPGEEERLVRV (SEQ ID NO:1734) of T08446_PEA_1_P18 (SEQ ID NO:1370).

According to preferred embodiments of the present invention, there is provided an isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLILSALQARSTDSLDGPGEGSVQPLPTAGGPSVK GKPGKRLSAPRG PFPRLADCAHFHYENVDF-GHIQLLLSPDREGPSLSGENELVF-GVQVTCQGRSWPVLRSY DDFRSLDAHLHR-CIFDRRFSCLPELPPPPEGARAAQMLVPLLLQYLETL SGLVDSNLNC GPVLTWMELDNHGRRLLLSEEA-SLNIPAVAAAHVIKRYTAQAPDELSFEVGDIVSVIDMPPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSEFIEAHGVVDGIYRLSGVSSNIQRL-RHEFDSERIPELSGPAFLQDIHSVSSLCKLYFRELPNPLLTYQLYGKFSEAMSVPGEEERLVRVHD-VIQQLPPPHYRTLEYLLRHLARMARHSANTSMHARNLAIVWAPNLLRSMELESVGMG-GAAAFREVRVQSVVVEFLLTHVDVLFSDTF TSA-GLDPAGRCLLPRPKSLAGSCPSTR-LLTLEEAQARTQGRLGTPTEPTTPKAPASPAERRKGERGEKQRKPGGSSWKTFFALGRGPS-VPRKKPLPWLGGTRAPPQPSGSRPDTVTLRSAKSEESLSSQASGAGLQRLHRLR-RPHSSSDAFPVGPAPAGSCESLSSSSSSESSSSESSSSSSESSAAGLGALSGSPSHRT-SAWLDDGDELDFSPPRCLEGLRGLDFD-PLTFRCSSPTPGDP APPASPAPPAPASAFPPRVT-PQAISPRGPTSPASPAALDISEPLAVSVPPAVLELLGA GGA PASATPTPALSPGRSLRPHLIPLLLR-GAEAPLTDACQQEMCSKLRGAQGPLGPDMESPLPPPPLSLLRPGGAPPPPPKNPARLMALA-LAERAQQVAEQQSQQECGGTPPASQSPFHRSLSLEVGGEPLGTSGSGPPPNSLAHP-GAWVPGPPPYLPRQQSDGSLLRSQRPMGTSRRG corresponding to amino acids 1-1010 of T08446_PEA_1_P18 (SEQ ID NO:1370), and a second amino acid sequence being at least 90% homologous to LRGPAQVSAQL-RAGGGGRDAPEAAAQSPCSVPSQVPTPG-FFSPAPRECLPPFLGVPKPG LYPLGPPSFQPSSPA-PVWRSSLGPPAPLDRGENLYYEIGASEGSPYSGPTRS WSPFRSMPP DRLNASYGMLGQSPPLHRSPDFLLSYP-PAPSCFPPDHLGYSAPQHPARRPTPPEPLYVNL ALG-PRGPSPASSSSSSPPAHPRSRSDPGP-PVPRLPQKQRAPWGPRTPHRVPGPWGPPEPLLLYRAAPPAYGRGGELHRGSLYRNG-GQRGEGAGPPPPYPTPSWSLHSEGQTRSYC corresponding to amino acids 1-295 of Q96CP3 (SEQ ID NO:1444), which also corresponds to amino acids 1011-1305 of T08446_PEA_1_P18 (SEQ ID NO:1370), wherein said first amino acid sequence and second amino acid sequence are contiguous and in a sequential order.

According to preferred embodiments of the present invention, there is provided an isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLIL-SALQARSTDSLDGPGEGSVQPLPTAG-GPSVKGKPGKRLSAPRG PFPRLADCAHFHYENVDFGHIQLLLSP-DREGPSLSGENELVFGVQVTCQGRSWPVLRSYDDFRSLDAHLHRCIFDRRFSCLPELPP-PPEGARAAQMLVPLLLQYLETLSGLVDSNLNC GPV-LTWMELDNHGRRLLLSEEA-SLNIPAVAAAHVIKRYTAQAPDELSFEVGDIVSVIDMPPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSEFIEAHGVVDGIYRLSGVSSNIQRL-RHEFDSERIPELSGPAFLQDIHSVSSLCKLYFRELPNPLLTYQLYGKFSEAMSVPGEEERLVRVHD-VIQQLPPPHYRTLEYLLRHLARMARHSANTSMHARNLAIVWAPNLLRSMELESVGMG-GAAAFREVRVQSVVVEFLLTHVDVLFSDTF TSA-GLDPAGRCLLPRPKSLAGSCPSTR-LLTLEEAQARTQGRLGTPTEPTTPKAPASPAERRKGERGEKQRKPGGSSWKTFFALGRGPS-VPRKKPLPWLGGTRAPPQPSGSRPDTVTLRSAKSEESLSSQASGAGLQRLHRLR-RPHSSSDAFPVGPAPAGSCESLSSSSSSESSSSESSSSSSESSAAGLGALSGSPSHRT-SAWLDDGDELDFSPPRCLEGLRGLDFD-PLTFRCSSPTPGDP APPASPAPPAPASAFPPRVT-PQAISPRGPTSPASPAALDISEPLAVSVPPAVLELLGA GGA PASATPTPALSPGRSLRPHLIPLLLR-GAEAPLTDACQQEMCSKLRGAQGPLGPDMESPLPPPPLSLLRPGGAPPPPPKNPARLMALA-LAERAQQVAEQQSQQECGGTPPASQSPFHRSLSLEVGGEPLGTSGSGPPPNSLAHP-GAWVPGPPPYLPRQQSDGSLLRSQRPMGTSRRG of T08446_PEA_1_P18 (SEQ ID NO:1370).

According to preferred embodiments of the present invention, there is provided an isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHL-WGPLILSALQARSTDSLDGPGEGSVQPLPTAGGPSV KGKPGKRLSAPRG PFPRLADCAHFHYENVDF-GHIQLLLSPDREGPSLSGENELVF-GVQVTCQGRSWPVLRSY DDFRSLDAHLHR-CIFDRRFSCLPELPPPPEGARAAQ corresponding to amino acids 1-154 of T08446_PEA_1_P18 (SEQ ID NO:1370), a second amino acid sequence being at least 90% homologous to MLVPLLLQYLETLSGLVDSNLNCGPV-LTWMELDNHGRRLLLSEEASLNIPAVAAAHVIKRYTAQAPDELSFEVGDIVSVIDMPPT-EDRSWWRGKRGFQVGFFPSECVELFTERPGPGLKADADGPPCGIPAPQGISSLT-SAVPRPRGKLAGLLRTFMRSRPSRQRL-RQRGILRQRVF GCDLGEHLSNSGQDVPQVLRCCSE-FIEAHGVVDGIYRLSGVSSNIQRLRHEFDSERIPELSGPAFLQDIHSVSSLCKLYFRELPN-PLLTYQLYGKFSEAMSVPGEEERLVRVHDVIQQLPPPHYRTLEYLLRHLARMARHSANTSM- HARNLAIVWAPNLLRSMELESVGMGGAAAFR EVRVQSVVVEFLLTHVDVLFSDTFTSAGLDPAGRCLLPRPKSLAGSCPSTRLLTLEEAQ ARTQGRLGTPTEPTTPKAPASPAERRKGERGEKQRKPGGSSWKTFFALGRGPSVPRKKP LPWLGGTRAPPQPSGSRPDTVTLRSAKSEESLSSQASGAGLQRLHRLRRPHSSSDAFPVG PAPAGSCESLSSSSSSESSSSESSSSSSESSAAGLGALSGSPSHRTSAWLDDGDELDFSPPR CLEGLRGLDFDPLTFRCSSPTPGDPAPPASPAPPAPASAFPPRVT PQAISPRGPTSPASPAA LDISEPLAVSVPPAVLELLGAGGAPASATPTPALSPGRSLRPHLIPLLLRGAEAPLTDACQ QEMCSKLRGAQGPLGPDMESPLPPPPLSLLRPGGAPPPPPKNPARLMALALAER AQQVA EQQSQQECGGTPPASQSPFHRSLSLEVGGEPLGTSGSGPPPNSLAHPGAWVPGPPPYLPR QQSDGSLLRSQRPMGTSRRGLRGPA corresponding to amino acids 1-861 of BAC86902 (SEQ ID NO:1445), which also corresponds to amino acids 155-1015 of T08446_PEA_1_P18 (SEQ ID NO:1370), a third amino acid sequence being at least 70%, optionally at least 80%, preferably at least 85%, more preferably at least 90% and most preferably at least 95% homologous to a polypeptide having the sequence QVSAQLRAGGGGRDAPEAAAQSPCSVPS corresponding to amino acids 1016-1043 of T08446_PEA_1_P18 (SEQ ID NO:1370), a fourth amino acid sequence being at least 90% homologous to QVPTPGFFSPAPRECLPPFLGVPKPGLYPLGPPSFQPSSPAPVWRSSLGPPAPLDRGENLY YEIGASEGSPYSGPTRSWSPFRSMPPDRLNASYGMLGQSPPLHRSPDFLLSYPPAPSCFPP DHLGYS corresponding to amino acids 862-989 of BAC86902 (SEQ ID NO:1445), which also corresponds to amino acids 1044-1171 of T08446_PEA_1_P18 (SEQ ID NO:1370), and a fifth amino acid sequence being at least 70%, optionally at least 80%, preferably at least 85%, more preferably at least 90% and most preferably at least 95% homologous to a polypeptide having the sequence APQHPARRPTPPEPLYVNLALGPRGPSPASSSSSSPPAHPRSRSDPGPPVPRLPQKQRAP WGPRTPHRVPGPWGPPEPLLLYRAAPPAYGRGGELHRGSLYRNGGQRGEGAGPPPPYP TPSWSLHSEGQTRSYC corresponding to amino acids 1172-1305 of T08446_PEA_1_P18 (SEQ ID NO:1370), wherein said first amino acid sequence, second amino acid sequence, third amino acid sequence, fourth amino acid sequence and fifth amino acid sequence are contiguous and in a sequential order.

According to preferred embodiments of the present invention, there is provided an isolated polypeptide encoding for a head of T08446_PEA_1_P118 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTDSLDGPGEGSVQPLPTAGGPSVKGKPGKRLSAPRG PFPRLADCAHFHYENVDFGHIQLLLSPDREGPSLSGENELVFGVQVTCQGRSWP VLRSY DDFRSLDAHLHRCIFDRRFSCLPELPPPPEGARAAQ of T08446_PEA_1_P18 (SEQ ID NO:1370).

According to preferred embodiments of the present invention, there is provided an isolated polypeptide encoding for an edge portion of T08446_PEA_1_P18 (SEQ ID NO:1370), comprising an amino acid sequence being at least 70%, optionally at least about 80%, preferably at least about 85%, more preferably at least about 90% and most preferably at least about 95% homologous to the sequence encoding for QVSAQLRAGGGGRDAPEAAAQSPCSVPS, corresponding to T08446_PEA_1_P18 (SEQ ID NO:1370).

According to preferred embodiments of the present invention, there is provided an isolated polypeptide encoding for a tail of T08446_PEA_1_P118 (SEQ ID NO:1370), comprising a polypeptide being at least 70%, optionally at least about 80%, preferably at least about 85%, more preferably at least about 90% and most preferably at least about 95% homologous to the sequence APQHPARRPTPPEPLYVNLALGPRGPSPASSSSSSPPAHPRSRSDPGPPVPRLPQKQRAP WGPRTPHRVPGPWGPPEPLLLYRAAPPAYGRGGELHRGSLYRNGGQRGEGAGPPPPYP TPSWSLHSEGQTRSYC in T08446_PEA_1_P18 (SEQ ID NO:1370).

According to preferred embodiments of the present invention, there is provided an isolated chimeric polypeptide encoding for T11628_PEA_1_P2 (SEQ ID NO:1376), comprising a first amino acid sequence being at least 70%, optionally at least 80%, preferably at least 85%, more preferably at least 90% and most preferably at least 95% homologous to a polypeptide having the sequence MGLSDGEWQLVLNVWGKVEADIPGHGQEVLIRLFKGHPETLEKFDKFKHLKSEDE (SEQ ID NO:1735) corresponding to amino acids 1-55 of T11628_PEA_1_P2 (SEQ ID NO:1376), and a second amino acid sequence being at least 90% homologous to MKASEDLKKHGATVLTALGGILKKKGHHEAEIKPLAQSHATKHKIPVKYLEFISECIIQV LQSKHPGDFGADAQGAMNKALELFRKDMASNYKELGFQG corresponding to amino acids 1-99 of Q8WVH6 (SEQ ID NO:1450), which also corresponds to amino acids 56-154 of T11628_PEA_1_P2 (SEQ ID NO:1376), wherein said first amino acid sequence and second amino acid sequence are contiguous and in a sequential order.

According to preferred embodiments of the present invention, there is provided an isolated polypeptide encoding for a head of T11628_PEA_1_P2 (SEQ ID NO:1376), comprising a polypeptide being at least 70%, optionally at least about 80%, preferably at least about 85%, more preferably at least about 90% and most preferably at least about 95% homologous to the sequence MGLSDGEWQLVLNVWGKVEADIPGHGQEVLIRLFKGHPETLEKFDKFKHLKSEDE (SEQ ID NO:1735) of T11628_PEA_1_P2 (SEQ ID NO:1376).

According to preferred embodiments of the present invention, there is provided an isolated chimeric polypeptide encoding for T11628_PEA_1_P5 (SEQ ID NO:1377), comprising a first amino acid sequence being at least 90% homologous to MKASEDLKKHGATVLTALGGILKKKGHHEAEIKPLAQSHATKHKIPVKYLEFISECIIQV LQSKHPGDFGADAQGAMNKALELFRKDMASNYKELGFQG corresponding to amino acids 56-154 of MYG_HUMAN_V1 (SEQ ID NO:1449), which also corresponds to amino acids 1-99 of T11628_PEA_1_P5 (SEQ ID NO:1377).

According to preferred embodiments of the present invention, there is provided an isolated chimeric polypeptide encoding for T11628_PEA_1_P7 (SEQ ID NO:1378), comprising a first amino acid sequence being at least 90% homologous to MGLSDGEWQLVLNVWGKVEADIPGHGQEVLIRLFKGHPETLEKFDKFKHLKSEDEMK ASEDLKKHGATVLTALGGILKKKGHHEAEIKPLAQSHATKHKIPVKYLEFISECIIQVLQ SKHPGDFGADAQGAMNK corresponding to amino acids 1-134 of MYG_HUMAN_V1 (SEQ ID NO:1449), which also corresponds to amino acids 1-134 of T11628_PEA_1_P7 (SEQ ID NO:1378), and a second amino acid sequence being at least 70%, optionally at least 80%, preferably at least 85%, more preferably at least 90% and most preferably at least 95% homologous to a polypeptide having the sequence G corresponding to amino acids 135-135 of T11628_PEA_1_P7 (SEQ ID NO:1378), wherein said first amino acid sequence and second amino acid sequence are contiguous and in a sequential order.

According to preferred embodiments of the present invention, there is provided an isolated chimeric polypeptide encoding for T11628_PEA_1_P10 (SEQ ID NO:1379), comprising a first amino acid sequence being at least 70%, optionally at least 80%, preferably at least 85%, more preferably at least 90% and most preferably at least 95% homologous to a polypeptide having the sequence MGLSDGEWQLVLNVWGKVEADIPGHGQEVLIRLFKGHPE TLEKFDKFKHLKSEDE (SEQ ID NO:1735) corresponding to amino acids 1-55 of T11628_PEA_1_P10 (SEQ ID NO:1379), and a second amino acid sequence being at least 90% homologous to MKASEDLKKHGATVLTALGGILKKKGHHEAEIKPLAQSHATKH-KIPVKYLEFISECIIQV LQSKHPGDFGADAQ-GAMNKALELFRKDMASNYKELGFQG corresponding to amino acids 1-99 of Q8WVH6 (SEQ ID NO:1450), which also corresponds to amino acids 56-154 of T11628_PEA_1_P10 (SEQ ID NO:1379), wherein said first amino acid sequence and second amino acid sequence are contiguous and in a sequential order.

According to preferred embodiments of the present invention, there is provided an isolated polypeptide encoding for a head of T11628_PEA_1_P10 (SEQ ID NO:1379), comprising a polypeptide being at least 70%, optionally at least about 80%, preferably at least about 85%, more preferably at least about 90% and most preferably at least about 95% homologous to the sequence MGLSDGEWQLVLNVWGKVEADIPGHGQEVLIRLFKGHPETLEKFDKFKHLKSEDE (SEQ ID NO:1735) of T11628_PEA_1_P10 (SEQ ID NO:1379).

According to preferred embodiments of the present invention, there is provided an isolated chimeric polypeptide encoding for R35137_PEA_1_PEA_1_PEA_1_P9 (SEQ ID NO:1385), comprising a first amino acid sequence being at least 90% homologous to MASSTGDRSQAVRHGLRAKVLTLDGMNPRVRRVEYAVRGPIV-QRALELEQELRQGVK KPFTEVIRAN-IGDAQAMGQRPITFLRQVLALCVNPDLLSSPNFPDD AKKRAERILQACG GHSLGAYSVSSGIQLIREDVARYI-ERRDGGIPADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEV corresponding to amino acids 1-274 of ALAT_HUMAN_V1 (SEQ ID NO:1453), which also corresponds to amino acids 1-274 of R35137_PEA_1_PEA_1_PEA_1_P9 (SEQ ID NO:1385), and a second amino acid sequence being at least 70%, optionally at least 80%, preferably at least 85%, more preferably at least 90% and most preferably at least 95% homologous to a polypeptide having the sequence RGAGEREAGQQSAPVTP-CALPGVPGQRVRRGFAVPLIQEGAHGD-GAALRRAAGACLLP LHLQGLHGRVRA-YEAGGGSRAMARPSSPDGPPPPPHLTWPCAGAGSA AAMWRW (SEQ ID NO:1737) corresponding to amino acids 275-385 of R35137_PEA_1_PEA_1_PEA_1_P9 (SEQ ID NO:1385), wherein said first amino acid sequence and second amino acid sequence are contiguous and in a sequential order.

According to preferred embodiments of the present invention, there is provided an isolated polypeptide encoding for a tail of R35137_PEA_1_PEA_1_PEA_1_P9 (SEQ ID NO:1385), comprising a polypeptide being at least 70%, optionally at least about 80%, preferably at least about 85%, more preferably at least about 90% and most preferably at least about 95% homologous to the sequence RGAGEREAGQQSAPVTP-CALPGVPGQRVRRGFAVPLIQEGAHGD-GAALRRAAGACLLP LHLQGLHGRVRA-YEAGGGSRAMARPSSPDGPPPPPHLTWPCAGAGSA AAMWRW (SEQ ID NO:1737) in R35137_PEA_1_PEA_1_PEA_1_P9 (SEQ ID NO:1385).

According to preferred embodiments of the present invention, there is provided an isolated chimeric polypeptide encoding for R35137_PEA_1_PEA_1_PEA_1_P8 (SEQ ID NO:1386), comprising a first amino acid sequence being at least 90% homologous to MASSTGDRSQAVRHGLRAKVLTLDGMNPRVRRVEYAVRGPIV-QRALELEQELRQGVK KPFTEVIRAN-IGDAQAMGQRPITFLRQVLALCVNPDLLSSPNFPDD AKKRAERILQACG GHSLGAYSVSSGIQLIREDVARYI-ERRDGGIPADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEVYQDNVYAAGSQFHSFKKVL MEMG-PPYAGQQELASFHSTSKGYMGEC corresponding to amino acids 1-320 of ALAT_HUMAN_V1 (SEQ ID NO:1453), which also corresponds to amino acids 1-320 of R35137_PEA_1_PEA_1_PEA_1_P8 (SEQ ID NO:1386), and a second amino acid sequence being at least 70%, optionally at least 80%, preferably at least 85%, more preferably at least 90% and most preferably at least 95% homologous to a polypeptide having the sequence VRTRRVGARGPWPGP-PRPMGHPLLRT (SEQ ID NO:1738) corresponding to amino acids 321-346 of R35137_PEA_1_PEA_1_PEA_1_P8 (SEQ ID NO:1386), wherein said first amino acid sequence and second amino acid sequence are contiguous and in a sequential order.

According to preferred embodiments of the present invention, there is provided an isolated polypeptide encoding for a tail of R35137_PEA_1_PEA_1_PEA_1_P8 (SEQ ID NO:1386), comprising a polypeptide being at least 70%, optionally at least about 80%, preferably at least about 85%, more preferably at least about 90% and most preferably at least about 95% homologous to the sequence VRTRRV-GARGPWPGPPRPMGHPLLRT (SEQ ID NO:1738) in R35137_PEA_1_PEA_1_PEA_1_P8 (SEQ ID NO:1386).

According to preferred embodiments of the present invention, there is provided an isolated chimeric polypeptide encoding for R35137_PEA_1_PEA_1_PEA_1_P11 (SEQ ID NO:1387), comprising a first amino acid sequence being at least 90% homologous to MASSTGDRSQAVRHGLRAKVLTLDGMNPRVRRVEYAVRGPIV-QRALELEQELRQGVK KPFTEVIRAN-IGDAQAMGQRPITFLRQVLALCVNPDLLSSPNFPDD AKKRAERILQACG GHSLGAYSVSSGIQLIREDVARYI-ERRDGGIPADPNNVFLSTGASDAIVTVLKLLVAGEG HTRTGVLIPIPQYPLYSATLAEL-GAVQVDYYLDEERAWALDVAELHRALGQAR corresponding to amino acids 1-229 of ALAT_HUMAN_V1 (SEQ ID NO:1453), which also corresponds to amino acids 1-229 of R35137_PEA_1_PEA_1_PEA_1_P11 (SEQ ID NO:1387), and a second amino acid sequence being at least 90% homologous to SGFGQREGTYHFRMTILPPLEKLR-LLLEKLSRFHAKFTLEYS corresponding to amino acids 455-496 of ALAT_HUMAN_V1 (SEQ ID NO:1453), which also corresponds to amino acids 230-271 of R35137_PEA_

1_PEA_1_PEA_1_P11 (SEQ ID NO:1387), wherein said first amino acid sequence and second amino acid sequence are contiguous and in a sequential order.

According to preferred embodiments of the present invention, there is provided an isolated chimeric polypeptide encoding for an edge portion of R35137_PEA_1_PEA_1_PEA_1_P11 (SEQ ID NO:1387), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RS, having a structure as follows: a sequence starting from any of amino acid numbers 229−x to 229; and ending at any of amino acid numbers 230+((n−2)−x), in which x varies from 0 to n−2.

According to preferred embodiments of the present invention, there is provided an isolated chimeric polypeptide encoding for R35137_PEA_1_PEA_1_PEA_1_P2 (SEQ ID NO:1388), comprising a first amino acid sequence being at least 90% homologous to MASSTGDRSQAVRHGLRAKVLTLDGMNPRVRRVEYAVRGPIV-QRALELEQELRQGVK KPFTEVIRAN-IGDAQAMGQRPITFLRQVLALCVNPDLLSSPNFPDD AKKRAERILQACG GHSLGAYSVSSGIQLIREDVARYI-ERRDGGIPADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEV corresponding to amino acids 1-274 of ALAT_HUMAN_V1 (SEQ ID NO:1453), which also corresponds to amino acids 1-274 of R35137_PEA_1_PEA_1_PEA_1_P2 (SEQ ID NO:1388), and a second amino acid sequence being at least 70%, optionally at least 80%, preferably at least 85%, more preferably at least 90% and most preferably at least 95% homologous to a polypeptide having the sequence RGAGEREAGQQSAPVTP-CALPGVPGQRVRRGFAVPLIQEGAHGD-GAALRRAAGACLLP LHLQGLHGRVRVPRRLCGGGE-HGRCSAAADAEADECAAVPAGARTGPAGPGGQPAR AHRPLLCAVPG (SEQ ID NO:1739) corresponding to amino acids 275-399 of R35137_PEA_1_PEA_1_PEA_1_P2 (SEQ ID NO:1388), wherein said first amino acid sequence and second amino acid sequence are contiguous and in a sequential order.

According to preferred embodiments of the present invention, there is provided an isolated polypeptide encoding for a tail of R35137_PEA_1_PEA_1_PEA_1_P2 (SEQ ID NO:1388), comprising a polypeptide being at least 70%, optionally at least about 80%, preferably at least about 85%, more preferably at least about 90% and most preferably at least about 95% homologous to the sequence RGAGEREAGQQSAPVTP-CALPGVPGQRVRRGFAVPLIQEGAHGD-GAALRRAAGACLLP LHLQGLHGRVRVPRRLCGGGE-HGRCSAAADAEADECAAVPAGARTGPAGPGGQPAR AHRPLLCAVPG (SEQ ID NO:1739) in R35137_PEA_1_PEA_1_PEA_1_P2 (SEQ ID NO:1388).

According to preferred embodiments of the present invention, there is provided an isolated chimeric polypeptide encoding for R35137_PEA_1_PEA_1_PEA_1_P4 (SEQ ID NO:1389), comprising a first amino acid sequence being at least 90% homologous to MASSTGDRSQAVRHGLRAKVLTLDGMNPRVRRVEYAVRGPIV-QRALELEQELRQGVK KPFTEVIRAN-IGDAQAMGQRPITFLRQVLALCVNPDLLSSPNFPDD AKKRAERILQACG GHSLGAYSVSSGIQLIREDVARYI-ERRDGGIPADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEVYQDNVYAAGSQFHSFKKVL MEMG-PPYAGQQELASFHSTSKGYMGECGFRG-GYVEVVNMDAAVQQQMLKLMSVRL CPPVPGQALLDLVVSPPAPTDPS-FAQFQAEKQAVLAELAAKAKLTEQVFNEAPGISCNP VQGAMYSFPRVQLPPRAVERAQELGLAP-DMFFCLRLLEETGICVVPGSGFGQREGTYH FRMTILPPLEKLRLLLEKLSRFHAKFTLE corresponding to amino acids 1-494 of ALAT_HUMAN_V1 (SEQ ID NO:1453), which also corresponds to amino acids 1-494 of R35137_PEA_1_PEA_1_PEA_1_P4 (SEQ ID NO:1389), and a second amino acid sequence being at least 70%, optionally at least 80%, preferably at least 85%, more preferably at least 90% and most preferably at least 95% homologous to a polypeptide having the sequence SPGRLWSPLYLLLMPG-GVGWGGCWAPASLQVPNKAVWQSD-SKKEALAAAWPAPTCL PFLQA (SEQ ID NO:1740) corresponding to amino acids 495-555 of R35137_PEA_1_PEA_1_PEA_1_P4 (SEQ ID NO:1389), wherein said first amino acid sequence and second amino acid sequence are contiguous and in a sequential order.

According to preferred embodiments of the present invention, there is provided an isolated polypeptide encoding for a tail of R35137_PEA_1_PEA_1_PEA_1_P4 (SEQ ID NO:1389), comprising a polypeptide being at least 70%, optionally at least about 80%, preferably at least about 85%, more preferably at least about 90% and most preferably at least about 95% homologous to the sequence SPGRLWS-PLYLLLMPGGVGWGGCWAPASLQVP-NKAVWQSDSKKEALAAAWPAPTCL PFLQA (SEQ ID NO:1740) in R35137_PEA_1_PEA_1_PEA_1_P4 (SEQ ID NO:1389).

According to preferred embodiments of the present invention, there is provided an isolated chimeric polypeptide encoding for R11723_PEA_1_P6 (SEQ ID NO:1410), comprising a first amino acid sequence being at least 70%, optionally at least 80%, preferably at least 85%, more preferably at least 90% and most preferably at least 95% homologous to a polypeptide having the sequence MWVLGIAATFCGLFLL-PGFALQIQCYQCEEFQLNNDC-SSPEFIVNCTVNVQDMCQKEV MEQSAGIMYRK-SCASSAACLIASAGSPCRGLAPGREEQRALHKAGAV GGGVR (SEQ ID NO:1741) corresponding to amino acids 1-110 of R11723_PEA_1_P6 (SEQ ID NO:1410), and a second amino acid sequence being at least 90% homologous to MYAQALLVVGVLQRQAAAQHLHEHPP-KLLRGHRVQERVDDRAEVEKRLREGEEDHV RPEVG-PRPVVLGFGRSHDPPNLVGH-PAYGQCHNNQPWADTSRRERQRKEKHSMRTQ corresponding to amino acids 1-112 of Q8IXM0 (SEQ ID NO:1707), which also corresponds to amino acids 111-222 of R11723_PEA_1_P6 (SEQ ID NO:1410), wherein said first and second amino acid sequences are contiguous and in a sequential order.

According to preferred embodiments of the present invention, there is provided an isolated polypeptide encoding for a head of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence MWVLGIAATFCGLFLLPGFALQIQ-CYQCEEFQLNNDCSSPEFIVNCTVNVQDMCQKEV MEQSAGIMYRKSCASSAACLIASAG- SPCRGLAPGREEQRALHKAGAVGGGVR (SEQ ID NO:1741) of R11723_PEA_1_P6 (SEQ ID NO:1410).

According to preferred embodiments of the present invention, there is provided an isolated chimeric polypeptide encoding for R11723_PEA_1_P6 (SEQ ID NO:1410), comprising a first amino acid sequence being at least 90% homologous to MWVLGIAATFCGLFLLPGFALQIQCYQCEEFQLNNDCSSPEFIVNCTVNVQDMCQKEVMEQSAGIMYRKSCASSAACLIASAG corresponding to amino acids 1-83 of Q96AC2 (SEQ ID NO:1708), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO:1742) corresponding to amino acids 84-222 of R11723_PEA_1_P6 (SEQ ID NO:1410), wherein said first and second amino acid sequences are contiguous and in a sequential order.

According to preferred embodiments of the present invention, there is provided an isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO:1742) in R11723_PEA_1_P6 (SEQ ID NO:1410).

According to preferred embodiments of the present invention, there is provided an isolated chimeric polypeptide encoding for R11723_PEA_1_P6 (SEQ ID NO:1410), comprising a first amino acid sequence being at least 90% homologous to MWVLGIAATFCGLFLLPGFALQIQCYQCEEFQLNNDCSSPEFIVNCTVNVQDMCQKEVMEQSAGIMYRKSCASSAACLIASAG corresponding to amino acids 1-83 of Q8N2G4 (SEQ ID NO:1709), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO:1742) corresponding to amino acids 84-222 of R11723_PEA_1_P6 (SEQ ID NO:1410), wherein said first and second amino acid sequences are contiguous and in a sequential order.

According to preferred embodiments of the present invention, there is provided an isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO:1742) in R11723_PEA_1_P6 (SEQ ID NO:1410).

According to preferred embodiments of the present invention, there is provided an isolated chimeric polypeptide encoding for R11723_PEA_1_P6 (SEQ ID NO:1410), comprising a first amino acid sequence being at least 90% homologous to MWVLGIAATFCGLFLLPGFALQIQCYQCEEFQLNNDCSSPEFIVNCTVNVQDMCQKEVMEQSAGIMYRKSCASSAACLIASAG corresponding to amino acids 24-106 of BAC85518 (SEQ ID NO:1710), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO:1742) corresponding to amino acids 84-222 of R11723_PEA_1_P6 (SEQ ID NO:1410), wherein said first and second amino acid sequences are contiguous and in a sequential order.

According to preferred embodiments of the present invention, there is provided an isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ (SEQ ID NO:1742) in R11723_PEA_1_P6 (SEQ ID NO:1410).

According to preferred embodiments of the present invention, there is provided an isolated chimeric polypeptide encoding for R11723_PEA_1_P7 (SEQ ID NO:1411), comprising a first amino acid sequence being at least 90% homologous to MWVLGIAATFCGLFLLPGFALQIQCYQCEEFQLNNDCSSPEFIVNCTVNVQDMCQKEVMEQSAG corresponding to amino acids 1-64 of Q96AC2 (SEQ ID NO:1708), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPGSNDHPT (SEQ ID NO:1743) corresponding to amino acids 65-93 of R11723_PEA_1_P7 (SEQ ID NO:1411), wherein said first and second amino acid sequences are contiguous and in a sequential order.

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1743) in R11723_PEA_1_P7 (SEQ ID NO:1411).

According to preferred embodiments of the present invention, there is provided an isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q8N2G4 (SEQ ID NO:1709), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO:1743) corresponding to amino acids 65-93 of R11723_PEA_1_P7 (SEQ ID NO:1411), wherein said first and second amino acid sequences are contiguous and in a sequential order.

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:1743) in R11723_PEA_1_P7 (SEQ ID NO:1411).

According to preferred embodiments of the present invention, there is provided an isolated chimeric polypeptide encoding for R11723_PEA_1_P7 (SEQ ID NO:1411), comprising a first amino acid sequence being at least 70%, optionally at least 80%, preferably at least 85%, more preferably at least 90% and most preferably at least 95% homologous to a polypeptide having the sequence MWVLG (SEQ ID NO:1744) corresponding to amino acids 1-5 of R11723_PEA_1_P7 (SEQ ID NO:1411), second amino acid sequence being at least 90% homologous to IAATFCGLFLL-PGFALQIQCYQCEEFQLNNDC-SSPEFIVNCTVNVQDMCQKEVMEQSAG corresponding to amino acids 22-80 of BAC85273, which also corresponds to amino acids 6-64 of R11723_PEA_1_P7 (SEQ ID NO:1411), and a third amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO:1743) corresponding to amino acids 65-93 of R11723_PEA_1_P7 (SEQ ID NO:1411), wherein said first, second and third amino acid sequences are contiguous and in a sequential order.

According to preferred embodiments of the present invention, there is provided an isolated polypeptide encoding for a head of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence MWVLG (SEQ ID NO:1744) of R11723_PEA_1_P7 (SEQ ID NO:1411).

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:1743) in R11723_PEA_1_P7 (SEQ ID NO:1411).

According to preferred embodiments of the present invention, there is provided an isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 24-87 of BAC85518 (SEQ ID NO:1710), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO:1743) corresponding to amino acids 65-93 of R11723_PEA_1_P7 (SEQ ID NO:1411), wherein said first and second amino acid sequences are contiguous and in a sequential order.

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:1743) in R11723_PEA_1_P7 (SEQ ID NO:1411).

According to preferred embodiments of the present invention, there is provided an isolated chimeric polypeptide encoding for R11723_PEA_1_P13 (SEQ ID NO:1412), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO:1708), which also corresponds to amino acids 1-63 of R11723_PEA_1_P13 (SEQ ID NO:1412), and a second amino acid sequence being at least 70%, optionally at least 80%, preferably at least 85%, more preferably at least 90% and most preferably at least 95% homologous to a polypeptide having the sequence DTKRTNTLLFEM-RHFAKQLTT (SEQ ID NO:1745) corresponding to amino acids 64-84 of R11723_PEA_1_P13 (SEQ ID NO:1412), wherein said first and second amino acid sequences are contiguous and in a sequential order.

According to preferred embodiments of the present invention, there is provided an isolated polypeptide encoding for a tail of R11723_PEA_1_P113 (SEQ ID NO:1412), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO:1745) in R11723_PEA_1_P13 (SEQ ID NO:1412).

According to preferred embodiments of the present invention, there is provided an isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO:1708), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO:1746) corresponding to amino acids 64-90 of R11723_PEA_1_P10 (SEQ ID NO:1413), wherein said first and second amino acid sequences are contiguous and in a sequential order.

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P11 (SEQ ID NO:1413).

According to preferred embodiments of the present invention, there is provided an isolated chimeric polypeptide encoding for R11723_PEA_1_P10 (SEQ ID NO:1413), comprising a first amino acid sequence being at least 90% homologous to MWVLGIAATFCGLFLLPGFALQIQCYQCEEFQLNNDCSSPEFIVNCTVNVQDMCQKEV MEQSA corresponding to amino acids 1-63 of Q8N2G4 (SEQ ID NO:1709), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:1746) corresponding to amino acids 64-90 of R11723_PEA_1_P10 (SEQ ID NO:1413), wherein said first and second amino acid sequences are contiguous and in a sequential order.

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

According to preferred embodiments of the present invention, there is provided an isolated chimeric polypeptide encoding for R11723_PEA_1_P10 (SEQ ID NO:1413), comprising a first amino acid sequence being at least 70%, optionally at least 80%, preferably at least 85%, more preferably at least 90% and most preferably at least 95% homologous to a polypeptide having the sequence MWVLG (SEQ ID NO:1744) corresponding to amino acids 1-5 of R11723_PEA_1_P10 (SEQ ID NO:1413), second amino acid sequence being at least 90% homologous to IAATFCGLFLLPGFALQIQCYQCEEFQLNNDCSSPEFIVNCTVNVQDMCQKEVMEQSA corresponding to amino acids 22-79 of BAC85273, which also corresponds to amino acids 6-63 of R11723_PEA_1_P10 (SEQ ID NO:1413), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:1746) corresponding to amino acids 64-90 of R11723_PEA_1_P10 (SEQ ID NO:1413), wherein said first, second and third amino acid sequences are contiguous and in a sequential order.

According to preferred embodiments of the present invention, there is provided an isolated polypeptide encoding for a head of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence MWVLG (SEQ ID NO:1744) of R11723_PEA_1_P10 (SEQ ID NO:1413).

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

According to preferred embodiments of the present invention, there is provided an isolated chimeric polypeptide encoding for R11723_PEA_1_P10 (SEQ ID NO:1413), comprising a first amino acid sequence being at least 90% homologous to MWVLGIAATFCGLFLLPGFALQIQCYQCEEFQLNNDCSSPEFIVNCTVNVQDMCQKEV MEQSA corresponding to amino acids 24-86 of BAC85518 (SEQ ID NO:1710), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:1746) corresponding to amino acids 64-90 of R11723_PEA_1_P10 (SEQ ID NO:1413), wherein said first and second amino acid sequences are contiguous and in a sequential order.

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

According to preferred embodiments of the present invention, there is provided an isolated chimeric polypeptide encoding for R16276_PEA_1_P7 (SEQ ID NO:1414), comprising a first amino acid sequence being at least 90% homologous to MQSVQSTSFCLRKQCLCLTFLLLHLLGQVAATQRCPPQCPG corresponding to amino acids 1-41 of NOV_HUMAN (SEQ ID NO:1463), which also corresponds to amino acids 1-41 of R16276_PEA_1_P7 (SEQ ID NO:1414), a bridging amino acid Q corresponding to amino acid 42 of R16276_PEA_1_P7 (SEQ ID NO:1414), a second amino acid sequence being at least 90% homologous to CPATPPTCAPGVRAVLDGCSCCLVCARQRGESCSDLEPCDESSGLYCDRSADPSNQTGI CT corresponding to amino acids 43-103 of NOV_HUMAN (SEQ ID NO:1463), which also corresponds to amino acids 43-103 of R16276_PEA_1_P7 (SEQ ID NO:1414), and a third amino acid sequence being at least 70%, optionally at least 80%, preferably at least 85%, more preferably at least 90% and most preferably at least 95% homologous to a polypeptide having the sequence GNPAPSAV (SEQ ID NO:1748) corresponding to amino acids 104-111 of R16276_PEA_1_P7 (SEQ ID NO:1414), wherein said first amino acid sequence, bridging amino acid, second amino acid sequence and third amino acid sequence are contiguous and in a sequential order.

According to preferred embodiments of the present invention, there is provided an isolated polypeptide encoding for a tail of R16276_PEA_1_P7 (SEQ ID NO:1414), comprising a polypeptide being at least 70%, optionally at least about 80%, preferably at least about 85%, more preferably at least about 90% and most preferably at least about 95% homologous to the sequence GNPAPSAV (SEQ ID NO:1748) in R16276_PEA_1_P7 (SEQ ID NO:1414).

According to preferred embodiments of the present invention, there is provided an isolated chimeric polypeptide encoding for R16276_PEA_1_P7 (SEQ ID NO:1414), comprising a first amino acid sequence being at least 90% homologous to MQSVQSTSFCLRKQCLCLT-FLLLHLLGQVAATQRCPPQCPG corresponding to amino acids 1-41 of NOV_HUMAN (SEQ ID NO:1463), which also corresponds to amino acids 1-41 of R16276_PEA_1_P7 (SEQ ID NO:1414), a bridging amino acid Q corresponding to amino acid 42 of R16276_PEA_1_P7 (SEQ ID NO:1414), a second amino acid sequence being at least 90% homologous to CPATPPTCAPGVRAVLDGCSCCLVCAR-QRGESCSDLEPCDESSGLYCDRSADPSNQTGI CT corresponding to amino acids 43-103 of NOV_HUMAN (SEQ ID NO:1463), which also corresponds to amino acids 43-103 of R16276_PEA_1_P7 (SEQ ID NO:1414), and a third amino acid sequence being at least 70%, optionally at least 80%, preferably at least 85%, more preferably at least 90% and most preferably at least 95% homologous to a polypeptide having the sequence GNPAPSAV (SEQ ID NO:1748) corresponding to amino acids 104-111 of R16276_PEA_1_P7 (SEQ ID NO:1414), wherein said first amino acid sequence, bridging amino acid, second amino acid sequence and third amino acid sequence are contiguous and in a sequential order.

According to preferred embodiments of the present invention, there is provided an isolated polypeptide encoding for a tail of R16276_PEA_1_P7 (SEQ ID NO:1414), comprising a polypeptide being at least 70%, optionally at least about 80%, preferably at least about 85%, more preferably at least about 90% and most preferably at least about 95% homologous to the sequence GNPAPSAV (SEQ ID NO:1748) in R16276_PEA_1_P7 (SEQ ID NO:1414).

According to preferred embodiments of the present invention, there is provided an isolated chimeric polypeptide encoding for HUMCEA_PEA_1_P4 (SEQ ID NO:1380), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILNVL corresponding to amino acids 1-234 of CEA5_HUMAN (SEQ ID NO:1451), which also corresponds to amino acids 1-234 of HUMCEA_PEA_1_P4 (SEQ ID NO:1380), and a second amino acid sequence being at least 70%, optionally at least 80%, preferably at least 85%, more preferably at least 90% and most preferably at least 95% homologous to a polypeptide having the sequence CEYICSSLAQAASPN-PQGQRQDFSVPLRFKYTDPQPWTSRLS-VTFCPRKTWADQVLTKN RRGGAASVLGGSGSTPYDGRNR (SEQ ID NO:1749) corresponding to amino acids 235-315 of HUMCEA_PEA_1_P4 (SEQ ID NO:1380), wherein said first amino acid sequence and second amino acid sequence are contiguous and in a sequential order.

According to preferred embodiments of the present invention, there is provided an isolated polypeptide encoding for a tail of HUMCEA_PEA_1_P4 (SEQ ID NO:1380), comprising a polypeptide being at least 70%, optionally at least about 80%, preferably at least about 85%, more preferably at least about 90% and most preferably at least about 95% homologous to the sequence CEYICSSLAQAASPNPQGQRQDFS-VPLRFKYTDPQPWTSRLSVTFCPRKTWADQVLTKN RRGGAASVLGGSGSTPYDGRNR (SEQ ID NO:1749) in HUMCEA_PEA_1_P4 (SEQ ID NO:1380).

According to preferred embodiments of the present invention, there is provided an isolated chimeric polypeptide encoding for HUMCEA_PEA_1_P5 (SEQ ID NO:1381), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILNVLYGPDA PTISPLNTSYRSGENLNLSCHAASNP-PAQYSWFVNGTFQQSTQELFIPNITVNNSGSYTC QAHNSDTGLNRTTVTTITVYAEPPK-PFITSNNSNPVEDEDAVALTCEPEIQNTTYLWWV NNQSLPVSPRLQLSNDNRTLTLLS-VTRNDVGPYECGIQNELSVDHSDPVILNVLYGPDD PTISPSYTYYRPGVNLSLSCHAASNP-PAQYSWLIDGNIQQHTQELFISNITEKNSGLYTCQ ANNSASGHSRTTVKTITVSAELPKP-SISSNNSKPVEDKDAVAFTCEPEAQNTTYLWWVN GQSLPVSPRLQLSNGNRTLTLFNVTRN-DARAYVCGIQNSVSANRSDPVTLDVLYGPDTP IISPP-DSSYLSGANLNLSCHSAS-NPSPQYSWRINGIPQQHTQVLFIAKITPNNNGTYACFV SNLATGRNNSIVKSITVS corresponding to amino acids 1-675 of CEA5_HUMAN (SEQ ID NO:1451), which also corresponds to amino acids 1-675 of HUMCEA_PEA_1_P5 (SEQ ID NO:1381), and a second amino acid sequence being at least 70%, optionally at least 80%, preferably at least 85%, more preferably at least 90% and most preferably at least 95% homologous to a polypeptide having the sequence GKWLP-GASASYSGVESIWFSPKSQEDIFF-PSLCSMGTRKSQILS (SEQ ID NO:1750) corresponding to amino acids 676-719 of HUMCEA_PEA_1_P5 (SEQ ID NO:1381), wherein said first amino acid sequence and second amino acid sequence are contiguous and in a sequential order.

According to preferred embodiments of the present invention, there is provided an isolated polypeptide encoding for a tail of HUMCEA_PEA_1_P5 (SEQ ID NO:1381), comprising a polypeptide being at least 70%, optionally at least about 80%, preferably at least about 85%, more preferably at least about 90% and most preferably at least about 95% homologous to the sequence GKWLPGASASYSGVESIWFSPK-SQEDIFFPSLCSMGTRKSQILS (SEQ ID NO:1750) in HUMCEA_PEA_1_P5 (SEQ ID NO:1381).

According to preferred embodiments of the present invention, there is provided an isolated chimeric polypeptide encoding for HUMCEA_PEA_1_P19 (SEQ ID NO:1383), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILN corresponding to amino acids 1-232 of CEA5_HUMAN (SEQ ID NO:1451), which also corresponds to amino acids 1-232 of HUMCEA_PEA_1_P19 (SEQ ID NO:1383), and a second amino acid sequence being at least 90% homologous to VLYGPDTPIISPPDSSYLSGANLNLSCH-SASNPSPQYSWRINGIPQQHTQVLFIAKITPNNN GTY-ACFVSNLATGRNNSIVKSITVSAS-GTSPGLSAGATVGIMIGVLVGVALI corresponding to amino acids 589-702 of CEA5_HUMAN (SEQ ID NO:1451), which also corresponds to amino acids 233-346 of HUMCEA_PEA_1_P19 (SEQ ID NO:1383), wherein said first amino acid sequence and second amino acid sequence are contiguous and in a sequential order.

According to preferred embodiments of the present invention, there is provided an isolated chimeric polypeptide encoding for an edge portion of HUMCEA_PEA_1_P19 (SEQ ID NO:1383), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NV, having a structure as follows: a sequence starting from any of amino acid numbers 232−x to 232; and ending at any of amino acid numbers 233+((n−2)−x), in which x varies from 0 to n−2.

According to preferred embodiments of the present invention, there is provided an isolated chimeric polypeptide encoding for HUMCEA_PEA_1_P20 (SEQ ID NO:1384), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYP corresponding to amino acids 1-142 of CEA5_HUMAN (SEQ ID NO:1451), which also corresponds to amino acids 1-142 of HUMCEA_PEA_1_P20 (SEQ ID NO:1384), and a second amino acid sequence being at least 90% homologous to ELPKPSISSNNSKPVED-KDAVAFTCEPEAQNTTYLWWVNGQS-LPVSPRLQLSNGNRTLT LFNVTRNDARAYVCGIQNS-VSANRSDPVTLDVLYGPDTPIISPPDSSYLSGANLNL SCHS ASNPSPQYSWRINGIPQQHTQVLFIAK-ITPNNNGTYACFVSNLATGRNNSIVKSITVSASG TSPGLSAGATVGIMIGVLVGVALI corresponding to amino acids 499-702 of CEA5_HUMAN (SEQ ID NO:1451), which also corresponds to amino acids 143-346 of HUMCEA_PEA_1_P20 (SEQ ID NO:1384), wherein said first amino acid sequence and second amino acid sequence are contiguous and in a sequential order.

According to preferred embodiments of the present invention, there is provided an isolated chimeric polypeptide encoding for an edge portion of HUMCEA_PEA_1_P20 (SEQ ID NO:1384), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PE, having a structure as follows: a sequence starting from any of amino acid numbers 142−x to 142; and ending at any of amino acid numbers 143+((n−2)−x), in which x varies from 0 to n−2.

According to preferred embodiments of the present invention, there is provided an isolated chimeric polypeptide encoding for Z44808_PEA_1_P5 (SEQ ID NO:1314), comprising a first amino acid sequence being at least 90% homologous to MLLPQLCWLPLLAGLLPPVPAQKF-SALTFLRVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKKSKPKKCVKKFVEYCDVNNDKSISVQ ELMGCLGVAKEDGKADTKKRHTPRGHAESTSNRQ corresponding to amino acids 1-441 of SMO2_HUMAN (SEQ ID NO:1430), which also corresponds to amino acids 1-441 of Z44808_PEA_1_P5 (SEQ ID NO:1314), and a second amino acid sequence being at least 70%, optionally at least 80%, preferably at least 85%, more preferably at least 90% and most preferably at least 95% homologous to a polypeptide having the sequence DAMVVSSRPKATTHRK-SRTLSRR (SEQ ID NO:1751) corresponding to amino acids 442-464 of Z44808_PEA_1_P5 (SEQ ID NO:1314), wherein said first and second amino acid sequences are contiguous and in a sequential order.

According to preferred embodiments of the present invention, there is provided an isolated polypeptide encoding for a tail of Z44808 PEA_1_P5 (SEQ ID NO:1314), comprising a polypeptide being at least 70%, optionally at least about 80%, preferably at least about 85%, more preferably at least about 90% and most preferably at least about 95% homologous to the sequence DAMVVSSRPKATTHRKSRTLSRR (SEQ ID NO:1751) in Z44808_PEA_1_P5 (SEQ ID NO:1314).

According to preferred embodiments of the present invention, there is provided an isolated chimeric polypeptide encoding for Z44808_PEA_1_P6 (SEQ ID NO:1315), comprising a first amino acid sequence being at least 90% homologous to MLLPQLCWLPLLAGLLPPVPAQKF-SALTFLRVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKKSKPKKCVKKFVEYCDVNNDKSISVQ ELMGCLGVAKEDGKADTKKRH corresponding to amino acids 1-428 of SMO2_HUMAN (SEQ ID NO:1430), which also corresponds to amino acids 1-428 of Z44808_PEA_1_P6 (SEQ ID NO:1315), and a second amino acid sequence being at least 70%, optionally at least 80%, preferably at least 85%, more preferably at least 90% and most preferably at least 95% homologous to a polypeptide having the sequence RSKRNL (SEQ ID NO:1752) corresponding to amino acids 429-434 of Z44808_PEA_1_P6 (SEQ ID NO:1315), wherein said first and second amino acid sequences are contiguous and in a sequential order.

According to preferred embodiments of the present invention, there is provided an isolated polypeptide encoding for a tail of Z44808_PEA_1_P6 (SEQ ID NO:1315), comprising a polypeptide being at least 70%, optionally at least about 80%, preferably at least about 85%, more preferably at least about 90% and most preferably at least about 95% homologous to the sequence RSKRNL (SEQ ID NO:1752) in Z44808_PEA_1_P6 (SEQ ID NO:1315).

According to preferred embodiments of the present invention, there is provided an isolated chimeric polypeptide encoding for Z44808_PEA_1_P7 (SEQ ID NO:1316), comprising a first amino acid sequence being at least 90% homologous to MLLPQLCWLPLLAGLLPPVPAQKF-SALTFLRVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKSKPKKCVKKFVEYCDVNNDKSISVQ ELMGCLGVAKEDGKADTKKRHTPRGHAESTSNRQ corresponding to amino acids 1-441 of SMO2_HUMAN (SEQ ID NO:1430), which also corresponds to amino acids 1-441 of Z44808_PEA_1_P7 (SEQ ID NO:1316), and a second amino acid sequence being at least 70%, optionally at least 80%, preferably at least 85%, more preferably at least 90% and most preferably at least 95% homologous to a polypeptide having the sequence LLWLRGKVSFYCF (SEQ ID NO:1753) corresponding to amino acids 442-454 of Z44808_PEA_1_P7 (SEQ ID NO:1316), wherein said first and second amino acid sequences are contiguous and in a sequential order.

According to preferred embodiments of the present invention, there is provided an isolated polypeptide encoding for a tail of Z44808_PEA_1_P7 (SEQ ID NO:1316), comprising a polypeptide being at least 70%, optionally at least about 80%, preferably at least about 85%, more preferably at least about 90% and most preferably at least about 95% homologous to the sequence LLWLRGKVSFYCF (SEQ ID NO:1753) in Z44808_PEA_1_P7 (SEQ ID NO:1316)

According to preferred embodiments of the present invention, there is provided an isolated chimeric polypeptide encoding for Z44808_PEA_1_P11 (SEQ ID NO:1317), comprising a first amino acid sequence being at least 90% homologous to MLLPQLCWLPLLAGLLPPVPAQKF-SALTFLRVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKT corresponding to amino acids 1-170 of SMO2_HUMAN (SEQ ID NO:1430), which also corresponds to amino acids 1-170 of Z44808_PEA_1_P11 (SEQ ID NO:1317), and a second amino acid sequence being at least 90% homologous to DIASRYPTLWTEQVKSRQNKTNKNSVSS-CDQEHQSALEEAKQPKNDNVVIPECAHGGL YKPVQCHPSTGYCWCVLVDT-GRPIPGTSTRYEQPKCDNTARAHPA-KARDLYKGRQLQ GCPGAKKHEFLTSVLDALSTDM-VHAASDPSSSSGRLSEPDPSHTLEERVVHWYFKLLD KNSSGDIGKKEIKPFKRFLRKKSKP-KKCVKKFVEYCDVNNDKSISVQELMGCLGVAKE DGKADTKKRHTPRGHAESTSNRQPRKQG corresponding to amino acids 188-446 of SMO2_HUMAN (SEQ ID NO:1430), which also corresponds to amino acids 171-429 of Z44808_PEA_1_P11 (SEQ ID NO:1317), wherein said first and second amino acid sequences are contiguous and in a sequential order.

According to preferred embodiments of the present invention, there is provided an isolated chimeric polypeptide encoding for an edge portion of Z44808_PEA_1_P11 (SEQ ID NO:1317), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 170−x to −170; and ending at any of amino acid numbers 171+((n−2)−x), in which x varies from 0 to n−2.

According to preferred embodiments of the present invention, there is provided an isolated chimeric polypeptide encoding for H61775_P16 (SEQ ID NO:1281), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 11-93 of Q9P2J2 (SEQ ID NO:1694), which also corresponds to amino acids 1-83 of H61775_P16 (SEQ ID NO:1281), and a second amino acid sequence being at least 70%, optionally at least 80%, preferably at least 85%, more preferably at least 90% and most preferably at least 95% homologous to a polypeptide having the sequence DCGFPAFRELKRA-ETVSPVFFTRRCIWEDLKSTGF-SPAGGGRPPGGGPRTQEDSGLPCW RSSCSVTLQV (SEQ ID NO:1754) corresponding to amino acids 84-152 of H61775_P16 (SEQ ID NO:1281), wherein said first and second amino acid sequences are contiguous and in a sequential order.

According to preferred embodiments of the present invention, there is provided an isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO:1754) in H61775_P16 (SEQ ID NO:1281).

According to preferred embodiments of the present invention, there is provided an isolated chimeric polypeptide encoding for H61775_P16 (SEQ ID NO:1281), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 1-83 of AAQ88495 (SEQ ID NO:1695), which also corresponds to amino acids 1-83 of H61775_P16 (SEQ ID NO:1281), and a second amino acid sequence being at least 70%, optionally at least 80%, preferably at least 85%, more preferably at least 90% and most preferably at least 95% homologous to a polypeptide having the sequence DCGF-PAFRELKRAETVSPVFFTRRCIWEDLK-STGFSPAGGGRPPGGGPRTQEDSGLPCW RSSCS-VTLQV (SEQ ID NO:1754) corresponding to amino acids 84-152 of H61775_P16 (SEQ ID NO:1281), wherein said first and second amino acid sequences are contiguous and in a sequential order.

According to preferred embodiments of the present invention, there is provided an isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO:1754) in H61775_P16 (SEQ ID NO:1281).

According to preferred embodiments of the present invention, there is provided an isolated chimeric polypeptide encoding for H61775_P17 (SEQ ID NO:1282), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 11-93 of Q9P2J2 (SEQ ID NO:1694), which also corresponds to amino acids 1-83 of H61775_P17 (SEQ ID NO:1282).

According to preferred embodiments of the present invention, there is provided an isolated chimeric polypeptide encoding for H61775_P17 (SEQ ID NO:1282), comprising a first amino acid sequence being at least 90% homologous to MVWCLGLAVLSLVISQGADGRGKPEVVS-VVGRAGESVVLGCDLLPPAGRPPLHVIEWL RFGFLL-PIFIQFGLYSPRIDPDYVG corresponding to amino acids 1-83 of AAQ88495 (SEQ ID NO:1695), which also corresponds to amino acids 1-83 of H61775_P17 (SEQ ID NO:1282).

According to preferred embodiments of the present invention, there is provided an isolated chimeric polypeptide encoding for M85491_PEA_1_P13 (SEQ ID NO:1283), comprising a first amino acid sequence being at least 90% homologous to MALRRLGAALLLLPLLAAVEETLMD-STTATAELGWMVHPPSGWEEVSGYDENMNTIR TYQVCNVFESSQNNWLRTKFIR-RRGAHRIHVEMKFSVRDCSSIPSVPGSCKETFNLYYY EADFDSATKTFPNWMENPWVKVD-TIAADESFSQVDLGGRVMKINTEVRSFGPVSRSGF YLAFQDYGGCMSLIAVRVFYRKCPRI-IQNGAIFQETLSGAESTSLVAARGSCIANAEEVD VPIKLYCNGDGEWLVPIGRCMCKAG-FEAVENGTVCRGCPSGTFKANQGDEACTHCPIN SRTTSEGATNCVCRNGYYRADLDPLD-MPCTTIPSAPQAVISSVNETSLMLEWTPPRDSG GREDLVYNIICKSCGSGRGACTRCGDN-VQYAPRQLGLTEPRIYISDLLAHTQYTFEIQAV NGVT-DQSPFSPQFASVNITTNQAAPSAVSIM-HQVSRTVDSITLSWSQPDQPNGVILDYEL QYYEK corresponding to amino acids 1-476 of EPB2_HUMAN (SEQ ID NO:1417), which also corresponds to amino acids 1-476 of M85491_PEA_1_P13 (SEQ ID NO:1283), and a second amino acid sequence being at least 70%, optionally at least 80%, preferably at least 85%, more preferably at least 90% and most preferably at least 95% homologous to a polypeptide having the sequence VPIGWVLSPSPTSLRA-PLPG (SEQ ID NO:1755) corresponding to amino acids 477-496 of M85491_PEA_1_P13 (SEQ ID NO:1283), wherein said first and second amino acid sequences are contiguous and in a sequential order.

According to preferred embodiments of the present invention, there is provided an isolated polypeptide encoding for a tail of M85491_PEA_1_P13 (SEQ ID NO:1283), comprising a polypeptide being at least 70%, optionally at least about 80%, preferably at least about 85%, more preferably at least about 90% and most preferably at least about 95% homologous to the sequence VPIGWVLSPSPTSLRAPLPG (SEQ ID NO:1755) in M85491_PEA_1_P13 (SEQ ID NO:1283).

According to preferred embodiments of the present invention, there is provided an isolated chimeric polypeptide encoding for M85491_PEA_1_P14 (SEQ ID NO:1284), comprising a first amino acid sequence being at least 90% homologous to MALRRLGAALLLLPLLAAVEETLMD-STTATAELGWMVHPPSGWEEVSGYDENMNTIR TYQVCNVFESSQNNWLRTKFIR-RRGAHRIHVEMKFSVRDCSSIPSVPGSCKETFNLYYY EADFDSATKTFPNWMENPWVKVD-TIAADESFSQVDLGGRVMKINTEVRSFGPVSRSGF YLAFQDYGGCMSLIAVRVFYRKCPRI-IQNGAIFQETLSGAESTSLVAARGSCIANAEEVD VPIKLYCNGDGEWLVPIGRCMCKAGFEAVENGTVCR corresponding to amino acids 1-270 of EPB2_HUMAN (SEQ ID NO:1417), which also corresponds to amino acids 1-270 of M85491_PEA_1_P14 (SEQ ID NO:1284), and a second amino acid sequence being at least 70%, optionally at least 80%, preferably at least 85%, more preferably at least 90% and most preferably at least 95% homologous to a polypeptide having the sequence ERQDLTMLSRLVLNSW-PQMILPPQPPKVLEL (SEQ ID NO:1756) corresponding to amino acids 271-301 of M85491_PEA_1_P14 (SEQ ID NO:1284), wherein said first and second amino acid sequences are contiguous and in a sequential order.

According to preferred embodiments of the present invention, there is provided an isolated polypeptide encoding for a tail of M85491_PEA_1_P14 (SEQ ID NO:1284), comprising a polypeptide being at least 70%, optionally at least about 80%, preferably at least about 85%, more preferably at least about 90% and most preferably at least about 95% homologous to the sequence ERQDLTMLSRLVLNSWPQMILP-PQPPKVLEL (SEQ ID NO: 1756) in M85491_PEA_1_P14 (SEQ ID NO:1284).

According to preferred embodiments of the present invention, there is provided an isolated chimeric polypeptide encoding for T399711_P6 (SEQ ID NO:1285), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFKGSQYWRFEDGV LDPDYPRNISDGFDGIPDNVDAALA-LPAHSYSGRERVYFFKG corresponding to amino acids 1-276 of VTNC_HUMAN (SEQ ID NO:1418), which also corresponds to amino acids 1-276 of T39971_P6 (SEQ ID NO:1285), and a second amino acid sequence being at least 70%, optionally at least 80%, preferably at least 85%, more preferably at least 90% and most preferably at least 95% homologous to a polypeptide having the sequence TQGV-VGD (SEQ ID NO:1757) corresponding to amino acids 277-283 of T39971_P6 (SEQ ID NO:1285), wherein said first and second amino acid sequences are contiguous and in a sequential order.

According to preferred embodiments of the present invention, there is provided an isolated polypeptide encoding for a tail of T39971_P6 (SEQ ID NO:1285), comprising a polypeptide being at least 70%, optionally at least about 80%, preferably at least about 85%, more preferably at least about 90% and most preferably at least about 95% homologous to the sequence TQGVVGD (SEQ ID NO:1757) in T39971_P6 (SEQ ID NO:1285).

According to preferred embodiments of the present invention, there is provided an isolated chimeric polypeptide encoding for T39971_P9 (SEQ ID NO:1286), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI- DAAFTRINCQGKTYLFKGSQYWRFEDGV LDPDYPRNISDGFDGIPDNVDAALA- LPAHSYSGRERVYFFKGKQYWEYQFQHPSQEE CEGSSLSAVFEHFAMMQRDSWEDIFELLFWGRT corresponding to amino acids 1-325 of VTNC_HUMAN (SEQ ID NO:1418), which also corresponds to amino acids 1-325 of T39971_P9 (SEQ ID NO:1286), and a second amino acid sequence being at least 90% homologous to SGMAPRPSLAKKQRFRHRNRKGYR- SQRGHSRGRNQNSRRPSRATWLSLFSSEESNLGA NNYDDYRMDWLVPATCEPIQSVFFFSGD- KYYRVNLRTRRVDTVDPPYPRSIAQYWLGC PAPGHL corresponding to amino acids 357-478 of VTNC_HUMAN (SEQ ID NO:1418), which also corresponds to amino acids 326-447 of T39971_P9 (SEQ ID NO:1286), wherein said first and second amino acid sequences are contiguous and in a sequential order.

According to preferred embodiments of the present invention, there is provided an isolated chimeric polypeptide encoding for an edge portion of T39971_P9 (SEQ ID NO:1286), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325-x to 325; and ending at any of amino acid numbers 326+((n-2)-x), in which x varies from 0 to n-2.

According to preferred embodiments of the present invention, there is provided an isolated chimeric polypeptide encoding for T39971_P11 (SEQ ID NO:1287), comprising a first amino acid sequence being at least 90% homologous to MAPLRPLLILALLAWVALADQESCK- GRCTEGFNVDKKCQCDELCSYYQSCCTDYTAEC KPQVTRGDVFTMPEDEYTVYDDGEEKN- NATVHEQVGGPSLTSDLQAQSKGNPEQTPV LKPEEEAPAPEVGASKPEGIDSRPETLH- PGRPQPPAEEELCSGKPFDAFTDLKNGSLFAFR GQY- CYELDEKAVRPGYPKLIRDVWGIEGPI- DAAFTRINCQGKTYLFKGSQYWRFEDGV LDPDYPRNISDGFDGIPDNVDAALA- LPAHSYSGRERVYFFKGKQYWEYQFQHPSQEE CEGSSLSAVFEHFAMMQRDSWEDIFELLFWGRTS corresponding to amino acids 1-326 of VTNC_HUMAN (SEQ ID NO:1418), which also corresponds to amino acids 1-326 of T39971_P11 (SEQ ID NO:1287), and a second amino acid sequence being at least 90% homologous to DKYYRVNLR- TRRVDTVDPPYPRSIAQYWLGCPAPGHL corresponding to amino acids 442-478 of VTNC_HUMAN (SEQ ID NO:1418), which also corresponds to amino acids 327-363 of T39971_P11 (SEQ ID NO:1287), wherein said first and second amino acid sequences are contiguous and in a sequential order.

According to preferred embodiments of the present invention, there is provided an isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n-2)-x), in which x varies from 0 to n-2.

According to preferred embodiments of the present invention, there is provided an isolated chimeric polypeptide encoding for T39971_P11 (SEQ ID NO:1287), comprising a first amino acid sequence being at least 90% homologous to MAPLRPLLILALLAWVALADQESCK- GRCTEGFNVDKKCQCDELCSYYQSCCTDYTAEC KPQVTRGDVFTMPEDEYTVYDDGEEKN- NATVHEQVGGPSLTSDLQAQSKGNPEQTPV LKPEEEAPAPEVGASKPEGIDSRPETLH- PGRPQPPAEEELCSGKPFDAFTDLKNGSLFAFR GQY- CYELDEKAVRPGYPKLIRDVWGIEGPI- DAAFTRINCQGKTYLFKGSQYWRFEDGV LDPDYPRNISDGFDGIPDNVDAALA- LPAHSYSGRERVYFFKGKQYWEYQFQHPSQEE CEGSSLSAVFEHFAMMQRDSWEDIFELLFWGRTS corresponding to amino acids 1-326 of Q9BSH7, which also corresponds to amino acids 1-326 of T39971_P11 (SEQ ID NO:1287), and a second amino acid sequence being at least 90% homologous to DKYYRVNLRTRRVDTVDPPYPR- SIAQYWLGCPAPGHL corresponding to amino acids 442-478 of Q9BSH7, which also corresponds to amino acids 327-363 of T39971_P11 (SEQ ID NO:1287), wherein said first and second amino acid sequences are contiguous and in a sequential order.

According to preferred embodiments of the present invention, there is provided an isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n-2)-x), in which x varies from 0 to n-2.

According to preferred embodiments of the present invention, there is provided an isolated chimeric polypeptide encoding for T39971_P12 (SEQ ID NO:1288), comprising a first amino acid sequence being at least 90% homologous to MAPLRPLLILALLAWVALADQESCK- GRCTEGFNVDKKCQCDELCSYYQSCCTDYTAEC KPQVTRGDVFTMPEDEYTVYDDGEEKN- NATVHEQVGGPSLTSDLQAQSKGNPEQTPV LKPEEEAPAPEVGASKPEGIDSRPETLH- PGRPQPPAEEELCSGKPFDAFTDLKNGSLFAFR GQY- CYELDEKAVRPGYPKLIRDVWGIEGPI- DAAFTRINCQGKTYLFK corresponding to amino acids 1-223 of VTNC_HUMAN (SEQ ID NO:1418), which also corresponds to amino acids 1-223 of T39971_P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1758) corresponding to amino acids 224-238 of T39971_P12 (SEQ ID NO:1288), wherein said first and second amino acid sequences are contiguous and in a sequential order.

According to preferred embodiments of the present invention, there is provided an isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1758) in T39971_P12 (SEQ ID NO:1288).

According to preferred embodiments of the present invention, there is provided an isolated chimeric polypeptide encoding for T39971_P12 (SEQ ID NO:1288), comprising a first amino acid sequence being at least 90% homologous to MAPLRPLLILALLAWVALADQESCK-GRCTEGFNVDKKCQCDELCSYYQSCCTDYTAEC KPQVTRGDVFTMPEDEYTVYDDGEEKN-NATVHEQVGGPSLTSDLQAQSKGNPEQTPV LKPEEEAPAPEVGASKPEGIDSRPETLH-PGRPQPPAEEELCSGKPFDAFTDLKNGSLFAFR GQY-CYELDEKAVRPGYPKLIRDVWGIEGPI-DAAFTRINCQGKTYLFK corresponding to amino acids 1-223 of Q9BSH7, which also corresponds to amino acids 1-223 of T39971_P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1758) corresponding to amino acids 224-238 of T39971_P12 (SEQ ID NO:1288), wherein said first and second amino acid sequences are contiguous and in a sequential order.

According to preferred embodiments of the present invention, there is provided an isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1758) in T39971_P12 (SEQ ID NO:1288).

According to preferred embodiments of the present invention, there is provided an isolated chimeric polypeptide encoding for Z21368_PEA_1_P2 (SEQ ID NO:1289), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHAAPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNRFRTNKKAKIWRDTFL VERGKFLRKKEESSKNIQQSNHLPKY-ERVKELCQQARYQTACEQPGQKWQCIEDTSGK LRI-HKCKGPSDLLTVRQSTRNLYARGFHDKD-KECSCRESGYRASRSQRKSQRQFLRNQ GTPKYKPRFVHTRQTRSLSVEFEGEIY-DINLEEEEELQVLQPRNIAKRHDEGHKGPRDLQ ASSGGNRGRMLADSSNAVGPPTTVRVTH-KCFILPNDSIHCERELYQSARAWKDHKAYI DKEIEALQDKIKNLREVRGHLKRRK-PEECSCSKQSYYNKEKGVKKQEKLKSHLHPFKE AAQEVDSKLQLFKENNRRRK-KERKEKRRQRKGEECSLPGLTCFTHDN-NHWQTAPFWN corresponding to amino acids 1-761 of SUL1_HUMAN (SEQ ID NO:1419), which also corresponds to amino acids 1-761 of Z21368_PEA_1_P2 (SEQ ID NO:1289), and a second amino acid sequence being at least 70%, optionally at least 80%, preferably at least 85%, more preferably at least 90% and most preferably at least 95% homologous to a polypeptide having the sequence PHKYSAHGRTRHFESATRTTNGAQKLSRI (SEQ ID NO:1759) corresponding to amino acids 762-790 of Z21368_PEA_1_P2 (SEQ ID NO:1289), wherein said first and second amino acid sequences are contiguous and in a sequential order.

According to preferred embodiments of the present invention, there is provided an isolated polypeptide encoding for a tail of Z21368_PEA_1_P2 (SEQ ID NO:1289), comprising a polypeptide being at least 70%, optionally at least about 80%, preferably at least about 85%, more preferably at least about 90% and most preferably at least about 95% homologous to the sequence PHKYSAHGRTRHFESATRTT-NGAQKLSRI (SEQ ID NO:1759) in Z21368_PEA_1_P2 (SEQ ID NO:1289).

According to preferred embodiments of the present invention, there is provided an isolated chimeric polypeptide encoding for Z21368_PEA_1_P5 (SEQ ID NO:1290), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of Q7Z2W2 (SEQ ID NO:1697), which also corresponds to amino acids 1-57 of Z21368_PEA_1_P5 (SEQ ID NO:1290), second bridging amino acid sequence comprising A, and a third amino acid sequence being at least 90% homologous to FFGKYLNEY-NGSYIPPGWREWLGLIKNSRFYNY-TVCRNGIKEKHGFDYAKDYFTDLITN ESINYFKM-SKRMYPHRPVMMVISHAAPHGPEDSAPQFSKLYPN ASQHITPSYNYAPNM DKHWIMQYTGPMLPIHMEFT-NILQRKRLQTLMSVDDSVERLYNMLVET-GELENTYIIYT ADHGYHIGQFGLVKGKSMPYD-FDIRVPFFIRGPSVEPGSIVPQIVLNIDLAPTILDIAGLDT PPDVDGKSVLKLLDPEKPGNRFRT-NKKAKIWRDTFLVERGKFLRKKEESSKNIQQSNHL PKYERVKELCQQARYQTACEQPGQK-WQCIEDTSGKLRIHKCKGPSDLLTVRQSTRNLY ARG-FHDKDKECSCRESGYRASRSQRKSQRQ-FLRNQGTPKYKPRFVHTRQTRSLSVEFE GEIYDINLEEEEELQVLQPRNIAKRHDE-GHKGPRDLQASSGGNRGRMLADSSNAVGPPT TVRVTHKCFILPNDSIHCERELYQSA-RAWKDHKAYIDKEIEALQDKIKNLREVRGHLKR RKPEECSCSKQSYYNKEKGVKKQEKLK-SHLHPFKEAAQEVDSKLQLFKENNRRRKER KEKRRQRKGEECSLPGLTCFTHDN-NHWQTAPFWNLGSFCACTSSNNNTYWCLRTVNE THNFLFCEFATGFLEYFDMNTDPYQLT-NTVHTVERGILNQLHVQLMELRSCQGYKQCN PRP-KNLDVGNKDGGSYDLHRGQLWDGWEG corresponding to amino acids 139-871 of Q7Z2W2 (SEQ ID NO:1697), which also corresponds to amino acids 59-791 of Z21368_PEA_1_P5 (SEQ ID NO:1290), wherein said first, second and third amino acid sequences are contiguous and in a sequential order.

According to preferred embodiments of the present invention, there is provided an isolated polypeptide encoding for an edge portion of Z21368_PEA_1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LAF having a structure as follows (numbering according to Z21368_PEA_1_P5 (SEQ ID NO:1290)): a sequence starting from any of amino acid numbers 57−x to 57; and ending at any of amino acid numbers 59+((n−2)−x), in which x varies from 0 to n−2.

According to preferred embodiments of the present invention, there is provided an isolated chimeric polypeptide encoding for Z21368_PEA_1_P5 (SEQ ID NO:1290), comprising a first amino acid sequence being at least 70%, optionally at least 80%, preferably at least 85%, more preferably at least 90% and most preferably at least 95% homologous to a polypeptide having the sequence MKYSCCALVLAVLGTELLGSLCSTVRSPRFRGRIQQERKNIRPNIILVLTDDQDVELAFF GKYLNEYNGSYIPPGWREWLGLIKNSRFYNYTVCRNGIKEKHGFDYAKDYFTDLITNES INYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTAD HGYHIGQFGLVKGKSMPYDFDIRVPFFIRGPSVEPGSIVPQIVLNIDLAPTILDIAGL DTPP DVDGKSVLKLLDPEKPGNRFRTNKKAKIWRDTFLVERGKFLRKKEESSKNIQQSNHLP KYERVKELCQQARYQTACEQPGQKWQCIEDTSGKLRIHKCKGPSDLLTVRQSTRNLYA RGFHDKDKECSCRESGYRASRSQRKSQRQFLRNQGTPKYKPRFVHTRQTRSLSVEFEGE IYDINLEEEEELQVLQPRNIAKRHDEGHKGPRDLQASSGGNRGRMLADSSNAVGPPTTV RVTHKCFILPNDSIHCERELYQSARAWKDHKAYIDKEIEALQDKIKNLREVRGHLKRRK PEECSCSKQSYYNKEKGVKKQEKLKSHLHPFKEAAQEVDSKLQLFKENNRRRKERKE KRRQRKGEECSLPGLTCFTHDNNHWQTAPFWNLGSFCACTSSNNNTYWCLRTVNETH NFLFCEFATGFLEYFDMNTDPYQLTNTVHTVERGILNQLHVQLME (SEQ ID NO:1760) corresponding to amino acids 1-751 of Z21368_PEA_1_P5 (SEQ ID NO:1290), and a second amino acid sequence being at least 90% homologous to LRSCQGYKQCNPRPKNLDVGNKDGGSYDLHRGQLWDGWEG corresponding to amino acids 1-40 of AAH12997 (SEQ ID NO:1698), which also corresponds to amino acids 752-791 of Z21368_PEA_1_P5 (SEQ ID NO:1290), wherein said first and second amino acid sequences are contiguous and in a sequential order.

According to preferred embodiments of the present invention, there is provided an isolated polypeptide encoding for a head of Z21368_PEA_1_P5 (SEQ ID NO:1290), comprising a polypeptide being at least 70%, optionally at least about 80%, preferably at least about 85%, more preferably at least about 90% and most preferably at least about 95% homologous to the sequence MKYSCCALVLAVLGTELLGSLCSTVRSPRFRGRIQQERKNIRPNIILVLTDDQDVELAFF GKYLNEYNGSYIPPGWREWLGLIKNSRFYNYTVCRNGIKEKHGFDYAKDYFTDLITNES INYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTAD HGYHIGQFGLVKGKSMPYDFDIRVPFFIRGPSVEPGSIVPQIVLNIDLAPTILDIAGL DTPP DVDGKSVLKLLDPEKPGNRFRTNKKAKIWRDTFLVERGKFLRKKEESSKNIQQSNHLP KYERVKELCQQARYQTACEQPGQKWQCIEDTSGKLRIHKCKGPSDLLTVRQSTRNLYA RGFHDKDKECSCRESGYRASRSQRKSQRQFLRNQGTPKYKPRFVHTRQTRSLSVEFEGE IYDINLEEEEELQVLQPRNIAKRHDEGHKGPRDLQASSGGNRGRMLADSSNAVGPPTTV RVTHKCFILPNDSIHCERELYQSARAWKDHKAYIDKEIEALQDKIKNLREVRGHLKRRK PEECSCSKQSYYNKEKGVKKQEKLKSHLHPFKEAAQEVDSKLQLFKENNRRRKERKE KRRQRKGEECSLPGLTCFTHDNNHWQTAPFWNLGSFCACTSSNNNTYWCLRTVNETH NFLFCEFATGFLEYFDMNTDPYQLTNTVHTVERGILNQLHVQLME (SEQ ID NO:1760) of Z21368_PEA_1_P5 (SEQ ID NO:1290).

According to preferred embodiments of the present invention, there is provided an isolated chimeric polypeptide encoding for Z21368_PEA_1_P5 (SEQ ID NO:1290), comprising a first amino acid sequence being at least 90% homologous to MKYSCCALVLAVLGTELLGSLCSTVRSPRFRGRIQQERKNIRPNIILVLTDDQDVEL corresponding to amino acids 1-57 of SUL1_HUMAN (SEQ ID NO:1419), which also corresponds to amino acids 1-57 of Z21368_PEA_1_P5 (SEQ ID NO:1290), and a second amino acid sequence being at least 90% homologous to AFFGKYLNEYNGSYIPPGWREWLGLIKNSRFYNYTVCRNGIKEKHGFDYAKDYFTDLIT NESINYFKMSKRMYPHRPVMMVISHAAPHGPEDSAPQFSKL YPNASQHITPSYNYAPN MDKHWIMQYTGPMLPIHMEFTNILQRKRLQTLMSVDDSVERLYNMLVETGELENTYII YTADHGYHIGQFGLVKGKSMPYDFDIRVPFFIRGPSVEPGSIVPQIVLNIDLAPTILDIAGL DTPPDVDGKSVLKLLDPEKPGNRFRTNKKAKIWRDTFLVERGKFLRKKEESSKNIQQSN HLPKYERVKELCQQARYQTACEQPGQKWQCIEDTSGKLRIHKCKGPSDLLTVRQSTRN LYARGFHDKDKECSCRESGYRASRSQRKSQRQFLRNQGTPKYKPRFVHTRQTRSLSVE FEGEIYDINLEEEEELQVLQPRNIAKRHDEGHKGPRDLQASSGGNRGRMLADSSNAVGP PTTVRVTHKCFILPNDSIHCERELYQSARAWKDHKAYIDKEIEALQDKIKNLREVRGHL KRRKPEECSCSKQSYYNKEKGVKKQEKLKSHLHPFKEAAQEVDSKLQLFKENNRRRK KERKEKRRQRKGEECSLPGLTCFTHDNNHWQTAPFWNLGSFCACTSSNNNTYWCLRT VNETHNFLFCEFATGFLEYFDMNTDPYQLTNTVHTVERGILNQLHVQLMELRSCQGYK QCNPRPKNLDVGNKDGGSYDLHRGQLWDGWEG corresponding to amino acids 138-871 of SUL1_HUMAN (SEQ ID NO:1419), which also corresponds to amino acids 58-791 of Z21368_PEA_1_P5 (SEQ ID NO:1290), wherein said first and second amino acid sequences are contiguous and in a sequential order.

According to preferred embodiments of the present invention, there is provided an isolated chimeric polypeptide encoding for an edge portion of Z21368_PEA_1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LA, having a structure as follows: a sequence starting from any of amino acid numbers 57−x to 57; and ending at any of amino acid numbers 58+((n−2)−x), in which x varies from 0 to n−2.

According to preferred embodiments of the present invention, there is provided an isolated chimeric polypeptide encoding for Z21368_PEA_1_P15 (SEQ ID NO:1291), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHAAPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNRFRTNKKAKIWRDTFL VERG corresponding to amino acids 1-416 of SUL1_HUMAN (SEQ ID NO:1419), which also corresponds to amino acids 1-416 of Z21368_PEA_1_P15 (SEQ ID NO:1291).

According to preferred embodiments of the present invention, there is provided an isolated chimeric polypeptide encoding for Z21368_PEA_1_P16 (SEQ ID NO:1292), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHAAPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNR corresponding to amino acids 1-397 of SUL1_HUMAN (SEQ ID NO:1419), which also corresponds to amino acids 1-397 of Z21368_PEA_1_P16 (SEQ ID NO:1292), and a second amino acid sequence being at least 70%, optionally at least 80%, preferably at least 85%, more preferably at least 90% and most preferably at least 95% homologous to a polypeptide having the sequence CVIVP-PLSQPQIH (SEQ ID NO:1761) corresponding to amino acids 398-410 of Z21368_PEA_1_P16 (SEQ ID NO:1292), wherein said first and second amino acid sequences are contiguous and in a sequential order.

According to preferred embodiments of the present invention, there is provided an isolated polypeptide encoding for a tail of Z21368_PEA_1_P116 (SEQ ID NO:1292), comprising a polypeptide being at least 70%, optionally at least about 80%, preferably at least about 85%, more preferably at least about 90% and most preferably at least about 95% homologous to the sequence CVIVPPLSQPQIH (SEQ ID NO:1761) in Z21368_PEA_1_P16 (SEQ ID NO:1292).

According to preferred embodiments of the present invention, there is provided an isolated chimeric polypeptide encoding for Z21368_PEA_1_P22 (SEQ ID NO:1293), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRTAFFGKYLNEY-NGSYIPPGWREWLGLIKNSRFYNYTVCR NGIKEKHGFDYAK corresponding to amino acids 1-188 of SUL1_HUMAN (SEQ ID NO:1419), which also corresponds to amino acids 1-188 of Z21368_PEA_1_P22 (SEQ ID NO:1293), and a second amino acid sequence being at least 70%, optionally at least 80%, preferably at least 85%, more preferably at least 90% and most preferably at least 95% homologous to a polypeptide having the sequence ARYDGDQPRCAPRPRGLSPTVF (SEQ ID NO:1762) corresponding to amino acids 189-210 of Z21368_PEA_1_P22 (SEQ ID NO:1293) wherein said first and second amino acid sequences are contiguous and in a sequential order.

According to preferred embodiments of the present invention, there is provided an isolated polypeptide encoding for a tail of Z21368_PEA_1_P22 (SEQ ID NO:1293), comprising a polypeptide being at least 70%, optionally at least about 80%, preferably at least about 85%, more preferably at least about 90% and most preferably at least about 95% homologous to the sequence ARYDGDQPRCAPRPRGLSPTVF (SEQ ID NO:1762) in Z21368_PEA_1_P22 (SEQ ID NO:1293).

According to preferred embodiments of the present invention, there is provided an isolated chimeric polypeptide encoding for Z21368_PEA_1_P23 (SEQ ID NO:1294), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRT corresponding to amino acids 1-137 of Q7Z2W2 (SEQ ID NO:1697), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1763) corresponding to amino acids 138-145 of Z21368_PEA_1_P23 (SEQ ID NO:1294), wherein said first and second amino acid sequences are contiguous and in a sequential order.

According to preferred embodiments of the present invention, there is provided an isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO:1763) in Z21368_PEA_1_P23 (SEQ ID NO:1294).

According to preferred embodiments of the present invention, there is provided an isolated chimeric polypeptide encoding for Z21368_PEA_1_P23 (SEQ ID NO:1294), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRT corresponding to amino acids 1-137 of SUL1_HUMAN (SEQ ID NO:1419), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1763) corresponding to amino acids 138-145 of Z21368_PEA_1_P23 (SEQ ID NO:1294), wherein said first and second amino acid sequences are contiguous and in a sequential order.

According to preferred embodiments of the present invention, there is provided an isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO:1763) in Z21368_PEA_1_P23 (SEQ ID NO:1294).

According to preferred embodiments of the present invention, there is provided an isolated chimeric polypeptide encoding for HUMGRP5E_P4 (SEQ ID NO:1299), comprising a first amino acid sequence being at least 90% homologous to MRGSELPLVLLALVLCLAPRGRAVPLPAGGGTVLTKMYPRGNHWAVGHLMGKKSTG ESSSVSERGSLKQQLREYIRWEEAARN- LLGLIEAKENRNHQPPQPKALGNQQPSWDSED SSN- FKDVGSKGK corresponding to amino acids 1-127 of GRP_HUMAN (SEQ ID NO:1421), which also corresponds to amino acids 1-127 of HUMGRP5E_P4 (SEQ ID NO:1299), and a second amino acid sequence being at least 90% homologous to GSQREGRNPQLNQQ corresponding to amino acids 135-148 of GRP_HUMAN (SEQ ID NO:1421), which also corresponds to amino acids 128-141 of HUMGRP5E_P4 (SEQ ID NO:1299), wherein said first and second amino acid sequences are contiguous and in a sequential order.

According to preferred embodiments of the present invention, there is provided an isolated chimeric polypeptide encoding for an edge portion of HUMGRP5E_P4 (SEQ ID NO:1299), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127−x to 127; and ending at any of amino acid numbers 128+((n−2)−x), in which x varies from 0 to n−2.

According to preferred embodiments of the present invention, there is provided an isolated chimeric polypeptide encoding for HUMGRP5E_P5 (SEQ ID NO:1300), comprising a first amino acid sequence being at least 90% homologous to MRGSELPLVLLALVLCLAPRGRAVPLPAGGGTVLTKMYPRGNHWAVGHLMGKKSTG ESSSVSERGSLKQQLREYIRWEEAARN- LLGLIEAKENRNHQPPQPKALGNQQPSWDSED SSN- FKDVGSKGK corresponding to amino acids 1-127 of GRP_HUMAN (SEQ ID NO:1421), which also corresponds to amino acids 1-127 of HUMGRP5E_P5 (SEQ ID NO:1300), and a second amino acid sequence being at least 70%, optionally at least 80%, preferably at least 85%, more preferably at least 90% and most preferably at least 95% homologous to a polypeptide having the sequence DSLLQVLNVKEGTPS (SEQ ID NO:1764) corresponding to amino acids 128-142 of HUMGRP5E_P5 (SEQ ID NO:1300), wherein said first and second amino acid sequences are contiguous and in a sequential order.

According to preferred embodiments of the present invention, there is provided an isolated polypeptide encoding for a tail of HUMGRP5E_P5 (SEQ ID NO:1300), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO:1764) in HUMGRP5E_P5 (SEQ ID NO:1300)

According to preferred embodiments of the present invention, there is provided an isolated chimeric polypeptide encoding for D56406_PEA_1_P2 (SEQ ID NO:1301), comprising a first amino acid sequence being at least 90% homologous to MMAGMKIQLVCMLLLAFSSWSLCSD- SEEEMKALEADFLTNMHTSKISKAHVPSWKMT LLN- VCSLVNNLNSPAEETGEVHEEELVA- RRKLPTALDGFSLEAMLTIYQLHKICHSRAF QHWE corresponding to amino acids 1-120 of NEUT_HUMAN (SEQ ID NO:1422), which also corresponds to amino acids 1-120 of D56406_PEA_1_P2 (SEQ ID NO:1301), second amino acid sequence being at least 70%, optionally at least 80%, preferably at least 85%, more preferably at least 90% and most preferably at least 95% homologous to a polypeptide having the sequence ARWLTPVIPALWEAETGGSRGQEMETIPANT (SEQ ID NO:1773) corresponding to amino acids 121-151 of D56406_PEA_1_P2 (SEQ ID NO:1301), and a third amino acid sequence being at least 90% homologous to LIQEDILDTGNDKNGKEE- VIKRKIPYILKRQLYENKPRRPYILKRDSYYY corresponding to amino acids 121-170 of NEUT_HUMAN (SEQ ID NO:1422), which also corresponds to amino acids 152-201 of D56406_PEA_1_P2 (SEQ ID NO:1301), wherein said first, second and third amino acid sequences are contiguous and in a sequential order.

According to preferred embodiments of the present invention, there is provided an isolated polypeptide encoding for an edge portion of D56406_PEA_1_P2 (SEQ ID NO:1301), comprising an amino acid sequence being at least 70%, optionally at least about 80%, preferably at least about 85%, more preferably at least about 90% and most preferably at least about 95% homologous to the sequence encoding for ARWLTPVIPALWEAETGGSRGQEMETIPANT (SEQ ID NO:1773), corresponding to D56406_PEA_1_P2 (SEQ ID NO:1301).

According to preferred embodiments of the present invention, there is provided an isolated chimeric polypeptide encoding for D56406_PEA_1_P5 (SEQ ID NO:1302), comprising a first amino acid sequence being at least 90% homologous to MMAGMKIQLVCMLLLAFSSWSLC corresponding to amino acids 1-23 of NEUT_HUMAN (SEQ ID NO:1422), which also corresponds to amino acids 1-23 of D56406_PEA_1_P5 (SEQ ID NO:1302), and a second amino acid sequence being at least 90% homologous to SEEEMKALEADFLTNMHTSKISKAH- VPSWKMTLLNVCSLVNNLNSPAEETGEVHEEEL VARRKLPTALDGFSLEAMLTIYQLH- KICHSRAFQHWELIQEDILDTGNDKNGKEEVIKR KIPYILKRQLYENKPRRPYILKRDSYYY corresponding to amino acids 26-170 of NEUT_HUMAN (SEQ ID NO:1422), which also corresponds to amino acids 24-168 of D56406_PEA_1_P5 (SEQ ID NO:1302), wherein said first and second amino acid sequences are contiguous and in a sequential order.

According to preferred embodiments of the present invention, there is provided an isolated chimeric polypeptide encoding for an edge portion of D56406_PEA_1_P5 (SEQ ID NO:1302), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CS, having a structure as follows: a sequence starting from any of amino acid numbers 23−x to 24; and ending at any of amino acid numbers+((n−2)−x), in which x varies from 0 to n−2.

According to preferred embodiments of the present invention, there is provided an isolated chimeric polypeptide encoding for D56406_PEA_1_P6 (SEQ ID NO:1303), comprising a first amino acid sequence being at least 90% homologous to MMAGMKIQLVCMLLLAFSSWSLCSD-SEEEMKALEADFLTNMHTSK corresponding to amino acids 1-45 of NEUT_HUMAN (SEQ ID NO:1422), which also corresponds to amino acids 1-45 of D56406_PEA_1_P6 (SEQ ID NO:1303), and a second amino acid sequence being at least 90% homologous to LIQEDILDTGNDKNGKEE-VIKRKIPYILKRQLYENKPRRPYILKRDSYYY corresponding to amino acids 121-170 of NEUT_HUMAN (SEQ ID NO:1422), which also corresponds to amino acids 46-95 of D56406_PEA_1_P6 (SEQ ID NO:1303), wherein said first and second amino acid sequences are contiguous and in a sequential order.

According to preferred embodiments of the present invention, there is provided an isolated chimeric polypeptide encoding for an edge portion of D56406_PEA_1_P6 (SEQ ID NO:1303), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 45–x to 46; and ending at any of amino acid numbers 46+((n–2)–x), in which x varies from 0 to n–2.

According to preferred embodiments of the present invention, there is provided an isolated chimeric polypeptide encoding for F05068_PEA_1_P7 (SEQ ID NO:1304), comprising a first amino acid sequence being at least 90% homologous to MKLVSVALMYLGSLAFLGADTARLD-VASEFRKK corresponding to amino acids 1-33 of ADML_HUMAN (SEQ ID NO:1423), which also corresponds to amino acids 1-33 of F05068_PEA_1_P7 (SEQ ID NO:1304).

According to preferred embodiments of the present invention, there is provided an isolated chimeric polypeptide encoding for F05068_PEA_1_P8 (SEQ ID NO:1305), comprising a first amino acid sequence being at least 90% homologous to MKLVSVALMYLGSLAFLGADTARLD-VASEFRKKWNKWALSRGKRELRMSSSYPTGLA DVKAGPAQTLIRPQDMKGASRSPED corresponding to amino acids 1-82 of ADML_HUMAN (SEQ ID NO:1423), which also corresponds to amino acids 1-82 of F05068_PEA_1_P8 (SEQ ID NO:1305), and a second amino acid sequence being at least 70%, optionally at least 80%, preferably at least 85%, more preferably at least 90% and most preferably at least 95% homologous to a polypeptide having the sequence R corresponding to amino acids 83-83 of F05068_PEA_1_P8 (SEQ ID NO:1305), wherein said first and second amino acid sequences are contiguous and in a sequential order.

According to preferred embodiments of the present invention, there is provided an isolated chimeric polypeptide encoding for H14624_P15 (SEQ ID NO:1306), comprising a first amino acid sequence being at least 90% homologous to MLQGPGSLLLLFLASHCCLGSARGLFLF-GQPDFSYKRSNCKPIPANLQLCHGIEYQNMR LPN-LLGHETMKEVLEQAGAWIPLVMKQCHP-DTKKFLCSLFAPVCLDDLDETIQPCHSLC VQVKDRCAPVMSAFGFPWPDMLECDRF-PQDNDLCIPLASSDHLLPATEE corresponding to amino acids 1-167 of Q9HAP5 (SEQ ID NO:1701), which also corresponds to amino acids 1-167 of H14624_P15 (SEQ ID NO:1306), and a second amino acid sequence being at least 70%, optionally at least 80%, preferably at least 85%, more preferably at least 90% and most preferably at least 95% homologous to a polypeptide having the sequence GKPSLLLPHSLLG (SEQ ID NO:1765) corresponding to amino acids 168-180 of H14624_P15 (SEQ ID NO:1306), wherein said first and second amino acid sequences are contiguous and in a sequential order.

According to preferred embodiments of the present invention, there is provided an isolated polypeptide encoding for a tail of H14624_P15 (SEQ ID NO:1306), comprising a polypeptide being at least 70%, optionally at least about 80%, preferably at least about 85%, more preferably at least about 90% and most preferably at least about 95% homologous to the sequence GKPSLLLPHSLLG (SEQ ID NO:1765) in H14624_P15 (SEQ ID NO:1306).

According to preferred embodiments of the present invention, there is provided an isolated chimeric polypeptide encoding for H38804_PEA_1_P5 (SEQ ID NO:1307), comprising a first amino acid sequence being at least 70%, optionally at least 80%, preferably at least 85%, more preferably at least 90% and most preferably at least 95% homologous to a polypeptide having the sequence MGRVRTLAGEC-SAQAQAQSLLAVVLSAPPSGGTPSARLS-VRSPSPRDPWGLWAPVLQ (SEQ ID NO:1766) corresponding to amino acids 1-57 of H38804_PEA_1_P5 (SEQ ID NO:1307), and a second amino acid sequence being at least 90% homologous to MTGSNEFKLNQPPEDGISS-VKFSPNTSQFLLVSSWDTSVRLYDV-PANSMRLKYQHTGA VLDCAFYDPTHAWSG-GLDHQLKMHDLNTDQENLVGTHDAPIRCVEYCPEV NVMVTG SWDQTVKLWDPRTPCNAGTFSQPE-KVYTLSVSGDRLIVGTAGRRVLVWDLRNMGYVQ QRRESSLKYQTRCIRAFPNKQGYVLSS-IEGRVAVEYLDPSPEVQKKKYAFKCHRLKENN IEQIYPVNAISFHNIHNTFATGGSDG-FVNIWDPFNKKRLCQFHRYPTSIASLAFSNDGTTL AIASSYMYEMDDTEHPEDGIFIRQVTDAETKPK corresponding to amino acids 1-324 of BUB3_HUMAN (SEQ ID NO:1424), which also corresponds to amino acids 58-381 of H38804_PEA_1_P5 (SEQ ID NO:1307), wherein said first and second amino acid sequences are contiguous and in a sequential order.

According to preferred embodiments of the present invention, there is provided an isolated polypeptide encoding for a head of H38804_PEA_1_P5 (SEQ ID NO:1307), comprising a polypeptide being at least 70%, optionally at least about 80%, preferably at least about 85%, more preferably at least about 90% and most preferably at least about 95% homologous to the sequence MGRVRTLAGECSAQAQAQSLLAV-VLSAPPSGGTPSARLSVRSPSPRDPWGLWAPVLQ (SEQ ID NO:1766) of H38804_PEA_1_P5 (SEQ ID NO:1307).

According to preferred embodiments of the present invention, there is provided an isolated chimeric polypeptide encoding for H38804_PEA_1_P17 (SEQ ID NO:1308), comprising a first amino acid sequence being at least 70%, optionally at least 80%, preferably at least 85%, more preferably at least 90% and most preferably at least 95% homologous to a polypeptide having the sequence MGRVRT-LAGECSAQAQAQSLLAVVLSAPPSGGTPSARLSVRSP SPRDPWGLWAPVLQ (SEQ ID NO:1766) corresponding to amino acids 1-57 of H38804_PEA_1_P17 (SEQ ID NO:1308), and a second amino acid sequence being at least 90% homologous to MTGSNEFKLNQPPEDGISSVKFSP-NTSQFLLVSSWDTSVRLYDVPANSMRLKYQHTGA VLDCAFYDPTHAWSGGLDHQLKMHDLNT-DQENLVGTHDAPIRCVEYCPEVNVMVTG SWDQTVKLWDPRTPCNAGTFSQPE-KVYTLSVSGDRLIVGTAGRRVLVWDLRNMGYVQ QRRESSLKYQTRCIRAFPNKQGYVLSS- IEGRVAVEYLDPSPEVQKKKYAFKCHRLKENN IEQIYPVNAISFHNIHNTFATGGSDG-FVNIWDPFNKKRLCQFHRYPTSIASLAFSNDGTTL AIASSYMYEMDDTEHPEDGIFIRQVTDAETKPKSPCT corresponding to amino acids 1-328 of BUB3_HUMAN (SEQ ID NO:1424), which also corresponds to amino acids 58-385 of H38804_PEA_1_P17 (SEQ ID NO:1308), wherein said first and second amino acid sequences are contiguous and in a sequential order.

According to preferred embodiments of the present invention, there is provided an isolated polypeptide encoding for a head of H38804_PEA_1_P17 (SEQ ID NO:1308), comprising a polypeptide being at least 70%, optionally at least about 80%, preferably at least about 85%, more preferably at least about 90% and most preferably at least about 95% homologous to the sequence MGRVRTLAGECSAQAQAQSLLAV-VLSAPPSGGTPSARLSVRSPSPRDPWGLWAPVLQ (SEQ ID NO:1766) of H38804_PEA_1_P17 (SEQ ID NO:1308).

According to preferred embodiments of the present invention, there is provided an isolated chimeric polypeptide encoding for HSENA78_P2 (SEQ ID NO:1309), comprising a first amino acid sequence being at least 90% homologous to MSLLSSRAARVPGPSSSLCALLV-LLLLLTQPGPIASAGPAAAVLRELRCVCLQTTQGVHP KMISNLQVFAIGPQCSKVEVV corresponding to amino acids 1-81 of SZ05_HUMAN (SEQ ID NO:1425), which also corresponds to amino acids 1-81 of HSENA78_P2 (SEQ ID NO:1309).

According to preferred embodiments of the present invention, there is provided an isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLL-PRTFWTRKLMKFLLL (SEQ ID NO:1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFV QAIS-DARCVFDMGAEVGFSMYLLDIGGGFPGSEDVKLKF EEITGVINPALDKYFPSDSG VRIIAEPGRYYVASAFT-LAVNIIAKKIVLKEQTGSDDEDESSEQT-FMYYVNDGVYGSFN CILYDHAHVKPLLQKRPKPDE-KYYSSSIWGPTCDGLDRIVERCDLPEMHVGDWML FEN MGAYTVAAASTFNGFQRPTIYYVMSG-PAWQLMQQFQNPDFPPEVEEQDASTLPVSCA WESG-MKRHRAACASASINV corresponding to amino acids 151-461 of DCOR_HUMAN (SEQ ID NO:1426), which also corresponds to amino acids 30-340 of HUMODCA_P9 (SEQ ID NO:1310), wherein said first and second amino acid sequences are contiguous and in a sequential order.

According to preferred embodiments of the present invention, there is provided an isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMK-FLLL (SEQ ID NO:1768) of HUMODCA_P9 (SEQ ID NO:1310).

According to preferred embodiments of the present invention, there is provided an isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLL-PRTFWTRKLMKFLLL (SEQ ID NO:1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFV QAIS-DARCVFDMGAEVGFSMYLLDIGGGFPGSEDVKLKF EEITGVINPALDKYFPSDSG VRIIAEPGRYYVASAFT-LAVNIIAKKIVLKEQTGSDDEDESSEQT-FMYYVNDGVYGSFN CILYDHAHVKPLLQKRPKPDE-KYYSSSIWGPTCDGLDRIVERCDLPEMHVGDWML FEN MGAYTVAAASTFNGFQRPTIYYVMSG-PAWQLMQQFQNPDFPPEVEEQDASTLPVSCA WESG-MKRHRAACASASINV corresponding to amino acids 40-350 of AAA59968, which also corresponds to amino acids 30-340 of HUMODCA_P9 (SEQ ID NO:1310), wherein said first and second amino acid sequences are contiguous and in a sequential order.

According to preferred embodiments of the present invention, there is provided an isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMK-FLLL (SEQ ID NO:1768) of HUMODCA_P9 (SEQ ID NO:1310).

According to preferred embodiments of the present invention, there is provided an isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLL-PRTFWTRKLMKFLLL (SEQ ID NO:1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFV QAIS-DARCVFDMGAEVGFSMYLLDIGGGFPGSEDVKLKF EEITGVINPALDKYFPSDSG VRIIAEPGRYYVASAFT-LAVNIIAKKIVLKEQTGSDDEDESSEQT-FMYYVNDGVYGSFN CILYDHAHVKPLLQKRPKPDE-KYYSSSIWGPTCDGLDRIVERCDLPEMHVGDWML FEN MGAYTVAAASTFNGFQRPTIYYVMSG-PAWQLMQQFQNPDFPPEVEEQDASTLPVSCA WESG-MKRHRAACASASINV corresponding to amino acids 86-396 of AAH14562 (SEQ ID NO:1703), which also corresponds to amino acids 30-340 of HUMODCA_P9 (SEQ ID NO:1310), wherein said first and second amino acid sequences are contiguous and in a sequential order.

According to preferred embodiments of the present invention, there is provided an isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMK-FLLL (SEQ ID NO:1768) of HUMODCA_P9 (SEQ ID NO:1310).

According to preferred embodiments of the present invention, there is provided an isolated chimeric polypeptide encoding for R00299_P3 (SEQ ID NO:1311), comprising a first amino acid sequence being at least 70%, optionally at least 80%, preferably at least 85%, more preferably at least 90% and most preferably at least 95% homologous to a polypeptide having the sequence MAEKALLCPSSA-GLGTWPWVLNSAWPVLPLAVDQGVDWRPRGPV (SEQ ID NO:1769) corresponding to amino acids 1-44 of R00299_P3 (SEQ ID NO:1311), second amino acid sequence being at least 90% homologous to SSDQIEQLHRRFKQLS-GDQPTIRKENFNNVPDLELNPIR-SKIVRAFFDNRNLRKGPSGLA DEINFEDFLTIMSY-FRPIDTTMDEEQVELSRKEKLRFLFHMYDSDSDGRIT LEEYRNV corresponding to amino acids 74-191 of Q9NWT9 (SEQ ID NO:1704), which also corresponds to amino acids 45-162 of R00299_P3 (SEQ ID NO:1311), and a third amino acid sequence being at least 70%, optionally at least 80%, preferably at least 85%, more preferably at least 90% and most preferably at least 95% homologous to a polypeptide having the sequence VEELLSGNPHIEKE-SARSIADGAMMEAASVCMGQMEPDQVYE-GITFEDFLKIWQGIDIE TKMHVRFLNMETMALCH (SEQ ID NO:1770) corresponding to amino acids 163-238 of R00299_P3 (SEQ ID NO:1311), wherein said first, second and third amino acid sequences are contiguous and in a sequential order.

According to preferred embodiments of the present invention, there is provided an isolated polypeptide encoding for a head of R00299_P3 (SEQ ID NO:1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPV-LPLAVDQGVDWRPRGPV (SEQ ID NO:1769) of R00299_P3 (SEQ ID NO:1311).

According to preferred embodiments of the present invention, there is provided an isolated polypeptide encoding for a tail of R00299_P3 (SEQ ID NO:1311), comprising a polypeptide being at least 70%, optionally at least about 80%, preferably at least about 85%, more preferably at least about 90% and most preferably at least about 95% homologous to the sequence VEELLSGNPHIEKESARSIADGAM-MEAASVCMGQMEPDQVYEGITFEDFLKIWQGIDIE TKMHVRFLNMETMALCH (SEQ ID NO:1770) in R00299_P3 (SEQ ID NO:1311).

According to preferred embodiments of the present invention, there is provided an isolated chimeric polypeptide encoding for R00299_P3 (SEQ ID NO:1311), comprising a first amino acid sequence being at least 70%, optionally at least 80%, preferably at least 85%, more preferably at least 90% and most preferably at least 95% homologous to a polypeptide having the sequence MAEKALLCPSSA-GLGTWPWVLNSAWPVLPLAVDQGVDWRPRGPV (SEQ ID NO:1769) corresponding to amino acids 1-44 of R00299_P3 (SEQ ID NO:1311), and a second amino acid sequence being at least 90% homologous to SSDQIEQLHR-RFKQLSGDQPTIRKENFNNVPDLELN-PIRSKIVRAFFDNRNLRKGPSGLA DEINFEDFLTIMSY-FRPIDTTMDEEQVELSRKEKLRFLFHMYDSDSDGRIT LEEYRNVVE ELLSGNPHIEKESARSIADGAMMEAAS-VCMGQMEPDQVYEGITFEDFLKIWQGIDIETK MHVRFLNMETMALCH (SEQ ID NO:1770) corresponding to amino acids 21-214 of TESC_HUMAN (SEQ ID NO:1427), which also corresponds to amino acids 45-238 of R00299_P3 (SEQ ID NO:1311), wherein said first and second amino acid sequences are contiguous and in a sequential order.

According to preferred embodiments of the present invention, there is provided an isolated polypeptide encoding for a head of R00299_P3 (SEQ ID NO:1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPV-LPLAVDQGVDWRPRGPV (SEQ ID NO:1769) of R00299_P3 (SEQ ID NO:1311).

According to preferred embodiments of the present invention, there is provided an isolated chimeric polypeptide encoding for W60282_PEA_1_P14 (SEQ ID NO:1312), comprising a first amino acid sequence being at least 90% homologous to MRILQLILLALATGLVGGETRIIKG-FECKPHSQPWQAALFEKTRLLCGATLIAPRWLLTA AHCLKP corresponding to amino acids 1-66 of Q8IXD7 (SEQ ID NO:1705), which also corresponds to amino acids 1-66 of W60282_PEA_1_P14 (SEQ ID NO:1312), and a second amino acid sequence being at least 70%, optionally at least 80%, preferably at least 85%, more preferably at least 90% and most preferably at least 95% homologous to a polypeptide having the sequence TPASHLAMRQHHHH (SEQ ID NO:1771) corresponding to amino acids 67-80 of W60282_PEA_1_P14 (SEQ ID NO:1312), wherein said first and second amino acid sequences are contiguous and in a sequential order.

According to preferred embodiments of the present invention, there is provided an isolated polypeptide encoding for a tail of W60282_PEA_1_P14 (SEQ ID NO:1312), comprising a polypeptide being at least 70%, optionally at least about 80%, preferably at least 85%, more preferably at least about 90% and most preferably at least about 95% homologous to the sequence TPASHLAMRQHHHH (SEQ ID NO:1771) in W60282_PEA_1_P14 (SEQ ID NO:1312).

According to preferred embodiments of the present invention, there is provided an isolated chimeric polypeptide encoding for Z41644_PEA_1_P10 (SEQ ID NO:1313), comprising a first amino acid sequence being at least 90% homologous to MRLLAAALLLLLLALYTARVDG-SKCKCSRKGPKIRYSDVKKLEMKPKYPHCEEKMVII TTKSVSRYRGQEHCLHPKLQSTKRFIK-WYNAWNEKRR corresponding to amino acids 1-95 of SZ14_HUMAN (SEQ ID NO:1429), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO:1772) corresponding to amino acids 96-123 of Z41644_PEA_1_P10 (SEQ ID NO:1313), wherein said first and second amino acid sequences are contiguous and in a sequential order.

According to preferred embodiments of the present invention, there is provided an isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGP-PHQVI (SEQ ID NO:1772) in Z41644_PEA_1_P10 (SEQ ID NO:1313).

According to preferred embodiments of the present invention, there is provided an isolated chimeric polypeptide encoding for Z41644_PEA_1_P10 (SEQ ID NO:1313), comprising a first amino acid sequence being at least 90% homologous to MRLLAAALLLLLLALYTARVDG-SKCKCSRKGPKIRYSDVKKLEMKPKYPHCEEKMVII TTKSVSRYRGQEHCLHPKLQSTKRFIK-WYNAWNEKRR corresponding to amino acids 13-107 of Q9NS21 (SEQ ID NO:1706), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO:1772) corresponding to amino acids 96-123 of Z41644_PEA_1_P10 (SEQ ID NO:1313), wherein said first and second amino acid sequences are contiguous and in a sequential order.

According to preferred embodiments of the present invention, there is provided an isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGP-PHQVI (SEQ ID NO:1772) in Z41644_PEA_1_P10 (SEQ ID NO:1313).

According to preferred embodiments of the present invention, there is provided an isolated chimeric polypeptide encoding for Z41644_PEA_1_P10 (SEQ ID NO:1313), comprising a first amino acid sequence being at least 90% homologous to MRLLAAALLLLLLALYTARVDG-SKCKCSRKGPKIRYSDVKKLEMKPKYPHCEEKMVII TTKSVSRYRGQEHCLHPKLQSTKRFIK-WYNAWNEKRR corresponding to amino acids 13-107 of AAQ89265 (SEQ ID NO:781), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO:1772) corresponding to amino acids 96-123 of Z41644_PEA_1_P10 (SEQ ID NO:1313), wherein said first and second amino acid sequences are contiguous and in a sequential order.

According to preferred embodiments of the present invention, there is provided an isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGP-PHQVI (SEQ ID NO:1772) in Z41644_PEA_1_P10 (SEQ ID NO:1313).

According to preferred embodiments of the present invention, there is provided an antibody capable of specifically binding to an epitope of an amino acid sequences.

Optionally the amino acid sequence corresponds to a bridge, edge portion, tail, head or insertion.

Optionally the antibody is capable of differentiating between a splice variant having said epitope and a corresponding known protein.

According to preferred embodiments of the present invention, there is provided a kit for detecting lung cancer, comprising a kit detecting overexpression of a splice variant according to any of the above claims.

Optionally the kit comprises a NAT-based technology.

Optionally the kit further comprises at least one primer pair capable of selectively hybridizing to a nucleic acid sequence according to any of the above claims.

Optionally the kit further comprises at least one oligonucleotide capable of selectively hybridizing to a nucleic acid sequence according to any of the above claims.

Optionally the kit comprises an antibody according to any of the above claims.

Optionally the kit further comprises at least one reagent for performing an ELISA or a Western blot.

According to preferred embodiments of the present invention, there is provided a method for detecting lung cancer, comprising detecting overexpression of a splice variant according to any of the above claims.

Optionally the detecting overexpression is performed with a NAT-based technology.

Optionally detecting overexpression is performed with an immunoassay.

Optionally the immunoassay comprises an antibody according to any of the above claims.

According to preferred embodiments of the present invention, there is provided a biomarker capable of detecting lung cancer, comprising any of the above nucleic acid sequences or a fragment thereof, or any of the above amino acid sequences or a fragment thereof.

According to preferred embodiments of the present invention, there is provided a method for screening for lung cancer, comprising detecting lung cancer cells with a biomarker or an antibody or a method or assay according to any of the above claims.

According to preferred embodiments of the present invention, there is provided a method for diagnosing lung cancer, comprising detecting lung cancer cells with a biomarker or an antibody or a method or assay according to any of the above claims.

According to preferred embodiments of the present invention, there is provided a method for monitoring disease progression and/or treatment efficacy and/or relapse of lung cancer, comprising detecting lung cancer cells with a biomarker or an antibody or a method or assay according to any of the above claims.

According to preferred embodiments of the present invention, there is provided a method of selecting a therapy for lung cancer, comprising detecting lung cancer cells with a biomarker or an antibody or a method or assay according to any of the above claims and selecting a therapy according to said detection.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein. As used herein, the following terms have the meanings ascribed to them unless specified otherwise.

BRIEF DESCRIPTION OF DRAWINGS

FIG. 1 is schematic summary of cancer biomarkers selection engine and the wet validation stages.

FIG. 2. Schematic illustration, depicting grouping of transcripts of a given contig based on presence or absence of unique sequence regions.

FIG. 3 is schematic summary of quantitative real-time PCR analysis.

FIG. 4 is schematic presentation of the oligonucleotide based microarray fabrication.

FIG. 5 is schematic summary of the oligonucleotide based microarray experimental flow.

FIG. 6 is a histogram showing Cancer and cell-line vs. normal tissue expression for Cluster H61775, demonstrating overexpression in brain malignant tumors and a mixture of malignant tumors from different tissues.

FIG. 56a shows the results on scale:0-1200. FIG. 56b shows the results on scale: 0-24.

FIG. 57a shows the results on scale:0-2000. FIG. 57b shows the results on scale:0-42.

FIG. 63 is an amino acid sequence alignment, using NCBI BLAST default parameters, demonstrating similarity between the AA281370 lung cancer biomarker if the present invention to various proteins involved in WD40 domains of MAPK signal trunsduction pathway. FIG. 63*a*: amino acids at positions 40-790 of AA281370 polypeptide SEQ ID NO: 99 has 75% homology to mouse Mapkbp1 protein (gi|47124622). FIG. 63*b*: amino acids at positions 40-886 of the AA281370 polypeptide SEQ ID NO: 99 has 70% homology to rat JNK-binding protein JNKBP1 (gi|34856717).

FIG. 80: PSEC R11723_PEA_1_T5 PCR product sequence; In Red—PSEC Forward primer; In Blue—PSEC Reverse complementary sequence; and Highlighted sequence—PSEC variant R11723_PEA_1_T5 (SEQ ID NO:148) ORF.

FIG. 83: Protein sequence of PSEC variant R11723_PEA_1_T5 (SEQ ID NO:148); In red—6His tag; In blue—PSEC.

FIG. 84 shows the DNA sequence of H is PSEC T5 pRSETA; bold—H is PSEC T5 open reading frame; Italic—flanking DNA sequence which was verified by sequence analysis.

DESCRIPTION OF PREFERRED EMBODIMENTS

Figure 7:
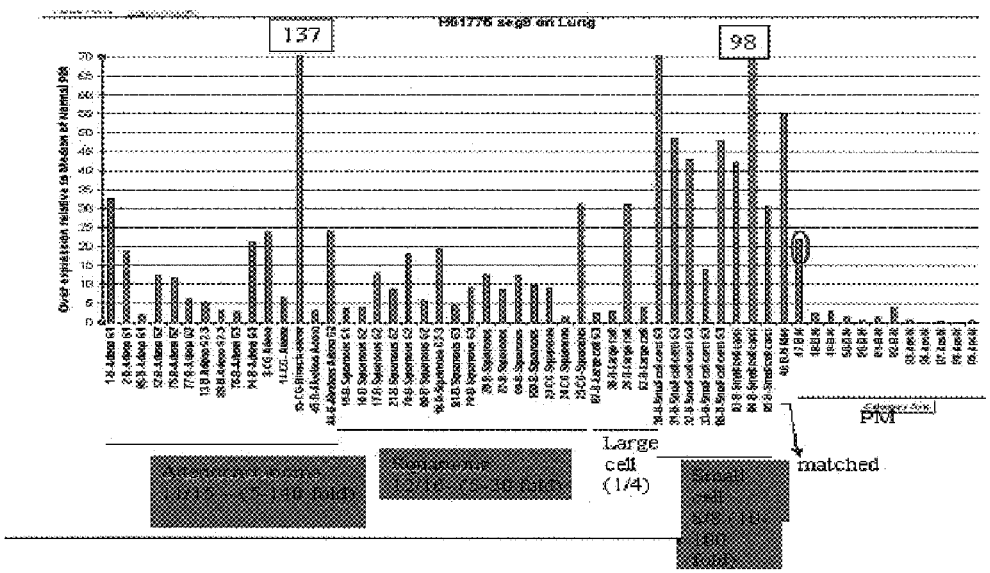
FIG. 7 is a histogram showing expression of transcripts of variants of the immunoglobulin superfamily, member 9, H61775 transcripts, which are detectable by amplicon as depicted in sequence name H61775seg8 (SEQ ID NO:1636), in normal and cancerous lung tissues.

The present invention is of novel markers for lung cancer that are both sensitive and accurate. Furthermore, at least certain of these markers are able to distinguish between various types of lung cancer, such as small cell carcinoma; large cell carcinoma; squamous cell carcinoma; and adenocarcinoma, alone or in combination. These markers are differentially expressed, and preferably overexpressed, in lung cancer specifically, as opposed to normal lung tissue. The measurement of these markers, alone or in combination, in patient samples provides information that the diagnostician can correlate with a probable diagnosis of lung cancer. The markers of the present invention, alone or in combination, show a high degree of differential detection between lung cancer and non-cancerous states. The markers of the present invention, alone or in combination, can be used for prognosis, prediction, screening, early diagnosis, therapy selection and treatment monitoring of lung cancer. For example, optionally and preferably, these markers may be used for staging lung cancer and/or monitoring the progression of the disease. Furthermore, the markers of the present invention, alone or in combination, can be used for detection of the source of metastasis found in anatomical places other than lung. Also, one or more of the markers may optionally be used in combination with one or more other lung cancer markers (other than those described herein). According to an optional embodiment of the present invention, such a combination may be used to differentiate between various types of lung cancer, such as small cell carcinoma; large cell carcinoma; squamous cell carcinoma; and adenocarcinoma. Furthermore, the markers of the present invention, alone or in combination, can be used for detection of other types of tumors by elimination (for example, for such detection of carcinoid tumors, which are 5% of lung cancers).

The markers of the present invention, alone or in combination, can be used for prognosis, prediction, screening, early diagnosis, staging, therapy selection and treatment monitoring of lung cancer. For example, optionally and preferably, these markers may be used for staging lung cancer and/or monitoring the progression of the disease. Furthermore, the markers of the present invention, alone or in combination, can be used for detection of the source of metastasis found in anatomical places other then lung. Also, one or more of the markers may optionally be used in combination with one or more other lung cancer markers (other than those described herein).

Biomolecular sequences (amino acid and/or nucleic acid sequences) uncovered using the methodology of the present invention and described herein can be efficiently utilized as tissue or pathological markers and/or as drugs or drug targets for treating or preventing a disease.

These markers are specifically released to the bloodstream under conditions of lung cancer, and/or are otherwise expressed at a much higher level and/or specifically expressed in lung cancer tissue or cells. The measurement of these markers, alone or in combination, in patient samples provides information that the diagnostician can correlate with a probable diagnosis of lung cancer.

The present invention therefore also relates to diagnostic assays for lung cancer and/or an indicative condition, and methods of use of such markers for detection of lung cancer and/or an indicative condition, optionally and preferably in a sample taken from a subject (patient), which is more preferably some type of blood sample.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

Optionally and preferably, a bridge between a tail or a head or a unique insertion, and a "known protein" portion of a variant, comprises at least about 10 amino acids, more preferably at least about 20 amino acids, most preferably at least about 30 amino acids, and even more preferably at least about 40 amino acids, in which at least one amino acid is from the tail/head/insertion and at least one amino acid is from the "known protein" portion of a variant. Also optionally, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49−x to 49 (for example); and ending at any of amino acid numbers 50+((n−2)−x) (for example), in which x varies from 0 to n−2. In this example, it should also be read as including bridges in which n is any number of amino acids between 10-50 amino acids in length. Furthermore, the bridge polypeptide cannot extend beyond the sequence, so it should be read such that 49−x (for example) is not less than 1, nor 50+((n−2)−x) (for example) greater than the total sequence length.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to the present invention, the splice variants described herein are non-limiting examples of markers for diagnosing lung cancer. Each splice variant marker of the present invention can be used alone or in combination, for various uses, including but not limited to, prognosis, prediction, screening, early diagnosis, determination of progression, therapy selection and treatment monitoring of lung cancer.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting lung cancer, such that a biomarker may optionally comprise any of the above.

According to still other preferred embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). U.S. patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

Preferably, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264, 166). The nucleic acid construct of the present invention can further include an enhancer, which can be adjacent or distant to the promoter sequence and can function in up regulating the transcription therefrom.

The nucleic acid construct of the present invention preferably further includes an appropriate selectable marker and/or an origin of replication. Preferably, the nucleic acid construct utilized is a shuttle vector, which can propagate both in E. coli (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (+/−), pGL3, PzeoSV2 (+/−), pDisplay, pEF/myc/cyto, pCMV/myc/cyto each of which is commercially available from Invitrogen Co. dot invitrogen dot com). Examples of retroviral vector and packaging systems are those sold by Clontech, San Diego, Calif., including Retro-X vectors pLNCX and pLXSN, which permit cloning into multiple cloning sites and the transgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Hybridization Assays

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and $5 \times 10^6$ cpm $^{32}$P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1% SDS and $5 \times 10^6$ cpm $^{32}$P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, FluorX (Amersham) and others [e.g., Kricka et al. (1992), Academic Press San Diego, Calif.] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3$H, $^{14}$C; $^{32}$P, and $^{35}$S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. WO9001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo- and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n = y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G–C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Optionally, nucleic acid sequence identity/homology may be determined by using BlastN software of the National Center of Biotechnology Information (NCBI) using default parameters, which preferably include using the DUST filter program, and also preferably include having an E value of 10, filtering low complexity sequences and a word size of 11. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), α-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—CO—), peptide derivatives (—N(R)—CH2-CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table 1 Non-conventional or Modified Amino Acids which can be Used with the Present Invention.

TABLE 1

| Non-conventional amino acid | Code | Non-conventional amino acid | Code |
|---|---|---|---|
| α-aminobutyric acid | Abu | L-N-methylalanine | Nmala |
| α-amino-α-methylbutyrate | Mgabu | L-N-methylarginine | Nmarg |
| aminocyclopropane-Carboxylate | Cpro | L-N-methylasparagine | Nmasn |
|  |  | L-N-methylaspartic acid | Nmasp |
| Aminoisobutyric acid | Aib | L-N-methylcysteine | Nmcys |
| aminonorbornyl-Carboxylate | Norb | L-N-methylglutamine | Nmgln |
|  |  | L-N-methylglutamic acid | Nmglu |
| Cyclohexylalanine | Chexa | L-N-methylhistidine | Nmhis |
| Cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |
| D-α-methylarginine | Dmarg | α-methylcyclopentylalanine | Mcpen |

TABLE 1-continued

| Non-conventional amino acid | Code | Non-conventional amino acid | Code |
|---|---|---|---|
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cyclododeclglycine | Ncdod |
| D-α-methylalnine | Dnmala | N-cyclooctylglycine | Ncoct |
| D-α-methylarginine | Dnmarg | N-cyclopropylglycine | Ncpro |
| D-α-methylasparagine | Dnmasn | N-cycloundecylglycine | Ncund |
| D-α-methylasparatate | Dnmasp | N-(2,2-diphenylethyl)glycine | Nbhm |
| D-α-methylcysteine | Dnmcys | N-(3,3-diphenylpropyl)glycine | Nbhe |
| D-N-methylleucine | Dnmleu | N-(3-indolylethyl) glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylserine | Dnmser |
| D-N-methyltryptophan | Dnmtrp | D-N-methylthreonine | Dnmthr |
| D-N-methyltyrosine | Dnmtyr | N-(1-methylethyl)glycine | Nva |
| D-N-methylvaline | Dnmval | N-methyla-napthylalanine | Nmanap |
| γ-aminobutyric acid | Gabu | N-methylpenicillamine | Nmpen |
| L-t-butylglycine | Tbug | N-(p-hydroxyphenyl)glycine | Nhtyr |
| L-ethylglycine | Etg | N-(thiomethyl)glycine | Ncys |
| L-homophenylalanine | Hphe | penicillamine | Pen |
| L-α-methylarginine | Marg | L-α-methylalanine | Mala |
| L-α-methylaspartate | Masp | L-α-methylasparagine | Masn |
| L-α-methylcysteine | Mcys | L-α-methyl-t-butylglycine | Mtbug |
| L-α-methylglutamine | Mgln | L-methylethylglycine | Metg |
| L-α-methylhistidine | Mhis | L-α-methylglutamate | Mglu |
| | | L-α-methylhomophenylalanine | Mhphe |
| L-α-methylisoleucine | Mile | N-(2-methylthioethyl)glycine | Nmet |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl)glycine | Nser |
| D-N-methylisoleucine | Dnmile | N-(imidazolylethyl)glycine | Nhis |
| D-N-methylleucine | Dnmleu | N-(3-indolylethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |

TABLE 1-continued

| Non-conventional amino acid | Code | Non-conventional amino acid | Code |
|---|---|---|---|
| L-α-methylnorvaline | Mnva | L-α-methylornithine | Morn |
| L-α-methylphenylalanine | Mphe | L-α-methylproline | Mpro |
| L-α-methylserine | mser | L-α-methylthreonine | Mthr |
| L-α-methylvaline | Mtrp | L-α-methyltyrosine | Mtyr |
| L-α-methylleucine | Mval Nnbhm | L-N-methylhomophenylalanine | Nmhphe |
| N-(N-(2,2-diphenylethyl) carbamylmethyl-glycine | Nnbhm | N-(N-(3,3-diphenylpropyl) carbamylmethyl(1)glycine | Nnbhe |
| 1-carboxy-1-(2,2-diphenyl ethylamino)cyclopropane | Nmbc | | |

Table 1 Cont.

Since the peptides of the present invention are preferably utilized in diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'$_2$ fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')$_2$, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11: 1271-77 (1993); and U.S. Pat. No. 4,946, 778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321: 522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545, 807; 5,545,806; 5,569,825; 5,625,126; 5,633,425; 5,661,016, and in the following scientific publications: Marks et al., Bio/Technology 10: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays

In another embodiment of the present invention, an immunoassay can be used to qualitatively or quantitatively detect and analyze markers in a sample. This method comprises:

providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168). Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10° C. to 40° C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

Preferably used are antibodies which specifically interact with the polypeptides of the present invention and not with wild type proteins or other isoforms thereof, for example. Such antibodies are directed, for example, to the unique sequence portions of the polypeptide variants of the present invention, including but not limited to bridges, heads, tails and insertions described in greater detail below. Preferred embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radio-labelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a colorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, colorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a colorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-imaging Methods

These methods include but are not limited to, positron emission tomography (PET) single photon emission computed tomography (SPECT). Both of these techniques are non-invasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein.

Display Libraries

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young A C, et al., "The three-dimensional structures of a polysaccharide binding antibody to *Cryptococcus neoformans* and its complex with a peptide from a phage display library: implications for the identification of peptide mimotopes" J Mol Biol 1997 Dec. 12; 274(4):622-34; Giebel L B et al. "Screening of cyclic peptide phage libraries identifies ligands that bind streptavidin with high affinities" Biochemistry 1995 Nov. 28; 34(47):15430-5; Davies E L et al., "Selection of specific phage-display antibodies using libraries derived from chicken immunoglobulin genes" J Immunol Methods 1995 Oct. 12; 186(1):125-35; Jones C R T al. "Current trends in molecular recognition and bioseparation" J Chromatogr A 1995 Jul. 14; 707(1):3-22; Deng S J et al. "Basis for selection of improved carbohydrate-binding single-chain antibodies from synthetic gene libraries" Proc Natl Acad Sci USA 1995 May 23; 92(11):4992-6; and Deng S J et al. "Selection of antibody single-chain variable fragments with improved carbohydrate binding by phage display" J Biol Chem 1994 Apr. 1; 269(13):9533-8, which are incorporated herein by reference.

The following sections relate to Candidate Marker Examples (first section) and to Experimental Data for these Marker Examples (second section).

CANDIDATE MARKER EXAMPLES SECTION

This Section relates to Examples of sequences according to the present invention, including illustrative methods of selection thereof.

Description of the methodology undertaken to uncover the biomolecular sequences of the present invention Human ESTs and cDNAs were obtained from GenBank versions 136 (Jun. 15, 2003 ftp dot ncbi dot nih dot gov/genbank/release dot notes/gb136 dot release dot notes); NCBI genome assembly of April 2003; RefSeq sequences from June 2003; Genbank version 139 (December 2003); Human Genome from NCBI (Build 34) (from October 2003); and RefSeq sequences from December 2003 dot With regard to GenBank sequences, the human EST sequences from the EST (GBEST) section and the human mRNA sequences from the primate (GBPRI) section were used; also the human nucleotide RefSeq mRNA sequences were used (see for example dot ncbi dot nlm dot nih dot gov/Genbank/Genbank-Overview dot html and for a reference to the EST section, see dot ncbi dot nlm dot nih dot gov/dbEST/; a general reference to dbEST, the EST database in GenBank, may be found in Boguski et al, Nat Genet. 1993 August; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No. 6,625,545; and U.S. patent application Ser. No. 10/426,002, published as U.S. 20040101876 on May 27, 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should noted that this explanation is provided for descriptive purposes only, and is not intended to be limiting in any way. The potential markers were identified by a computational process that was designed to find genes and/or their splice variants that are over-expressed in tumor tissues, by using databases of expressed sequences. Various parameters related to the information in the EST libraries, determined according to a manual classification process, were used to assist in locating genes and/or splice variants thereof that are over-expressed in cancerous tissues. The detailed description of the selection method is presented in Example 1 below. The cancer biomarkers selection engine and the following wet validation stages are schematically summarized in FIG. 1.

Example 1

Identification of Differentially Expressed Gene Products—Algorithm

In order to distinguish between differentially expressed gene products and constitutively expressed genes (i.e., house keeping genes) an algorithm based on an analysis of frequencies was configured. A specific algorithm for identification of transcripts over expressed in cancer is described hereinbelow.

Dry Analysis

Library annotation—EST libraries are manually classified according to:

Tissue origin

Biological source—Examples of frequently used biological sources for construction of EST libraries include cancer cell-lines; normal tissues; cancer tissues; fetal tissues; and others such as normal cell lines and pools of normal cell-lines, cancer cell-lines and combinations thereof. A specific description of abbreviations used below with regard to these tissues/cell lines etc is given above.

Protocol of library construction—various methods are known in the art for library construction including normalized library construction; non-normalized library construction; subtracted libraries; ORESTES and others. It will be appreciated that at times the protocol of library construction is not indicated.

The following rules are followed:

EST libraries originating from identical biological samples are considered as a single library.

EST libraries which included above-average levels of contamination, such as DNA contamination for example, were eliminated. The presence of such contamination was determined as follows. For each library, the number of unspliced ESTs that are not fully contained within other spliced sequences was counted. If the percentage of such sequences (as compared to all other sequences) was at least 4 standard deviations above the average for all libraries being analyzed, this library was tagged as being contaminated and was eliminated from further consideration in the below analysis (see also Sorek, R. & Safer, H. M. A novel algorithm for computational identification of contaminated EST libraries. Nucleic Acids Res 31, 1067-74 (2003) for further details).

Clusters (genes) having at least five sequences including at least two sequences from the tissue of interest were analyzed. Splice variants were identified by using the LEADS software package as described above.

Example 2

Identification of Genes Over Expressed in Cancer

Two different scoring algorithms were developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The algorithm—

Clone counting: For counting EST clones each library protocol class was given a weight based on our belief of how much the protocol reflects actual expression levels:

(i) non-normalized: 1
(ii) normalized: 0.2
(iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as $$\frac{c+1}{C} \bigg/ \frac{n+1}{N}$$

where:
c—weighted number of "cancer" clones in the cluster.
C—weighted number of clones in all "cancer" libraries.
n—weighted number of "normal" clones in the cluster.
N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.

Libraries/sequences originating from tumor tissues are counted as well as libraries originating from cancer cell-lines ("normal" cell-lines were ignored).

Only libraries/sequences originating from tumor tissues are counted

Example 3

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:

1. Each cluster includes at least 2 libraries from the tissue T. At least 3 clones (weighed—as described above) from tissue T in the cluster; and
2. Clones from the tissue T are at least 40% from all the clones participating in the tested cluster Fisher exact test P-values were computed both for library and weighted clone counts to check that the counts are statistically significant.

Example 4

Identification of Splice Variants Over Expressed in Cancer of Clusters which are not Over Expressed in Cancer Cancer-specific splice variants containing a unique region were identified.

Identification of Unique Sequence Regions in Splice Variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:

(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:

(i) Aligned to the genome; and
(ii) Regions supported by more than 2 ESTs.

The algorithm

Each unique sequence region divides the set of transcripts into 2 groups:

(i) Transcripts containing this region (group TA).
(ii) Transcripts not containing this region (group TB).

The set of EST clones of every cluster is divided into 3 groups:

(i) Supporting (originating from) transcripts of group TA (S1).
(ii) Supporting transcripts of group TB (S2).
(iii) Supporting transcripts from both groups (S3).

Library and clones number scores described above were given to S1 group.

Fisher Exact Test P-values were used to check if:

S1 is significantly enriched by cancer EST clones compared to S2; and

S1 is significantly enriched by cancer EST clones compared to cluster background (S1+S2+S3).

Identification of unique sequence regions and division of the group of transcripts accordingly is illustrated in FIG. 2. Each of these unique sequence regions corresponds to a segment, also termed herein a "node".

Region 1: common to all transcripts, thus it is not considered for detecting variants; Region 2: specific to Transcript 1; Region 3: specific to Transcripts 2 and 3; Region 4: specific to Transcript 3; Region 5: specific to Transcript 1 and 2; Region 6: specific to Transcript 1.

Example 5

Identification of Cancer Specific Splice Variants of Genes Over Expressed in Cancer A search for EST supported (no mRNA) regions for genes of:
(i) known cancer markers
(ii) Genes shown to be over-expressed in cancer in published micro-array experiments.

Reliable EST supported-regions were defined as supported by minimum of one of the following:

(i) 3 spliced ESTs; or
(ii) 2 spliced ESTs from 2 libraries;
(iii) 10 unspliced ESTs from 2 libraries, or
(iv) 3 libraries.

ACTUAL MARKER EXAMPLES

The following examples relate to specific actual marker examples.

Experimental Examples Section

This Section relates to Examples describing experiments involving these sequences, and illustrative, non-limiting examples of methods, assays and uses thereof. The materials and experimental procedures are explained first, as all experiments used them as a basis for the work that was performed.

The markers of the present invention were tested with regard to their expression in various cancerous and non-cancerous tissue samples. A description of the samples used in the panel is provided in Table 2 below. A description of the samples used in the normal tissue panel is provided in Table 3 below. Tests were then performed as described in the "Materials and Experimental Procedures" section below.

TABLE 2

Tissue samples in testing panel

| sample rename | Lot No. | source | pathology | Grade | gender/age |
|---|---|---|---|---|---|
| 1-B-Adeno G1 | A504117 | Biochain | Adenocarcinoma | 1 | F/29 |
| 2-B-Adeno G1 | A504118 | Biochain | Adenocarcinoma | 1 | M/64 |
| 95-B-Adeno G1 | A610063 | Biochain | Adenocarcinoma | 1 | F/54 |
| 12-B-Adeno G2 | A504119 | Biochain | Adenocarcinoma | 2 | F/74 |
| 75-B-Adeno G2 | A609217 | Biochain | Adenocarcinoma | 2 | M/65 |
| 77-B-Adeno G2 | A608301 | Biochain | Adenocarcinoma | 2 | M/44 |
| 13-B-Adeno G2-3 | A504116 | Biochain | Adenocarcinoma | 2-3 | M/64 |
| 89-B-Adeno G2-3 | A609077 | Biochain | Adenocarcinoma | 2-3 | M/62 |
| 76-B-Adeno G3 | A609218 | Biochain | Adenocarcinoma | 3 | M/57 |
| 94-B-Adeno G3 | A610118 | Biochain | Adenocarcinoma | 3 | M/68 |
| 3-CG-Adeno | CG-200 | Ichilov | Adenocarcinoma | | NA |
| 14-CG-Adeno | CG-111 | Ichilov | Adenocarcinoma | | M/68 |
| 15-CG-Bronch adeno | CG-244 | Ichilov | Bronchioloalveolar adenocarcinoma | | M/74 |
| 45-B-Alvelous Adeno | A501221 | Biochain | Alveolus carcinoma | | F/50 |
| 44-B-Alvelous Adeno G2 | A501123 | Biochain | Alveolus carcinoma | 2 | F/61 |
| 19-B-Squamous G1 | A408175 | Biochain | Squamous carcinoma | 1 | M/78 |
| 16-B-Squamous G2 | A409091 | Biochain | Squamous carcinoma | 2 | F/68 |
| 17-B-Squamous G2 | A503183 | Biochain | Squamous carcinoma | 2 | M/57 |
| 21-B-Squamous G2 | A503187 | Biochain | Squamous carcinoma | 2 | M/52 |
| 78-B-Squamous G2 | A607125 | Biochain | Squamous Cell Carcinoma | 2 | M/62 |
| 80-B-Squamous G2 | A609163 | Biochain | Squamous Cell Carcinoma | 2 | M/74 |
| 18-B-Squamous G2-3 | A503387 | Biochain | Squamous Cell Carcinoma | 2-3 | M/63 |
| 81-B-Squamous G3 | A609076 | Biochain | Squamous Carcinoma | 3 | m/53 |
| 79-B-Squamous G3 | A609018 | Biochain | Squamous Cell Carcinoma | 3 | M/67 |
| 20-B-Squamous | A501121 | Biochain | Squamous Carcinoma | | M/64 |
| 22-B-Squamous | A503386 | Biochain | Squamous Carcinoma | | M/48 |
| 88-B-Squamous | A609219 | Biochain | Squamous Cell Carcinoma | | M/64 |
| 100-B-Squamous | A409017 | Biochain | Squamous Carcinoma | | M/64 |

TABLE 2-continued

Tissue samples in testing panel

| sample rename | Lot No. | source | pathology | Grade | gender/age |
|---|---|---|---|---|---|
| 23-CG-Squamous | CG-109 (1) | Ichilov | Squamous Carcinoma | | M/65 |
| 24-CG-Squamous | CG-123 | Ichilov | Squamous Carcinoma | | M/76 |
| 25-CG-Squamous | CG-204 | Ichilov | Squamous Carcinoma | | M/72 |
| 87-B-Large cell G3 | A609165 | Biochain | Large Cell Carcinoma | 3 | F/47 |
| 38-B-Large cell | A504113 | Biochain | Large cell | | M/58 |
| 39-B-Large cell | A504114 | Biochain | Large cell | | F/35 |
| 82-B-Large cell | A609170 | Biochain | Large Cell Neuroendocrine Carcinoma | | M/68 |
| 30-B-Small cell carci G3 | A501389 | Biochain | small cell | 3 | M/34 |
| 31-B-Small cell carci G3 | A501390 | Biochain | small cell | 3 | F/59 |
| 32-B-Small cell carci G3 | A501391 | Biochain | small cell | 3 | M/30 |
| 33-B-Small cell carci G3 | A504115 | Biochain | small cell | 3 | M |
| 86-B-Small cell carci G3 | A608032 | Biochain | Small Cell Carcinoma | 3 | F/52 |
| 83-B-Small cell carci | A609162 | Biochain | Small Cell Carcinoma | | F/47 |
| 84-B-Small cell carci | A609167 | Biochain | Small Cell Carcinoma | | F/59 |
| 85-B-Small cell carci | A609169 | Biochain | Small Cell Carcinoma | | M/66 |
| 46-B-N M44 | A501124 | Biochain | Normal M44 | | F/61 |
| 47-B-N | A503205 | Biochain | Normal PM | | M/26 |
| 48-B-N | A503206 | Biochain | Normal PM | | M/44 |
| 49-B-N | A503384 | Biochain | Normal PM | | M/27 |
| 50-B-N | A503385 | Biochain | Normal PM | | M/28 |
| 90-B-N | A608152 | Biochain | Normal (Pool 2) PM | | pool 2 |
| 91-B-N | A607257 | Biochain | Normal (Pool 2) PM | | pool 2 |
| 92-B-N | A503204 | Biochain | Normal PM | | m/28 |
| 93-Am-N | 111P0103A | Ambion | Normal PM | | F/61 |
| 96-Am-N | 36853 | Ambion | Normal PM | | F/43 |
| 97-Am-N | 36854 | Ambion | Normal PM | | M/46 |
| 98-Am-N | 36855 | Ambion | Normal PM | | F/72 |
| 99-Am-N | 36856 | Ambion | Normal PM | | M/31 |

TABLE 3

Tissue samples in normal panel:

| | Lot no. | Source | Tissue | Pathology | Sex/Age |
|---|---|---|---|---|---|
| 1-Am-Colon (C71) | 071P10B | Ambion | Colon | PM | F/43 |
| 2-B-Colon (C69) | A411078 | Biochain | Colon | PM-Pool of 10 | M&F |
| 3-Cl-Colon (C70) | 1110101 | Clontech | Colon | PM-Pool of 3 | M&F |
| 4-Am-Small Intestine | 091P0201A | Ambion | Small Intestine | PM | M/75 |
| 5-B-Small Intestine | A501158 | Biochain | Small Intestine | PM | M/63 |
| 6-B-Rectum | A605138 | Biochain | Rectum | PM | M/25 |
| 7-B-Rectum | A610297 | Biochain | Rectum | PM | M/24 |
| 8-B-Rectum | A610298 | Biochain | Rectum | PM | M/27 |
| 9-Am-Stomach | 110P04A | Ambion | Stomach | PM | M/16 |
| 10-B-Stomach | A501159 | Biochain | Stomach | PM | M/24 |
| 11-B-Esophagus | A603814 | Biochain | Esophagus | PM | M/26 |
| 12-B-Esophagus | A603813 | Biochain | Esophagus | PM | M/41 |
| 13-Am-Pancreas | 071P25C | Ambion | Pancreas | PM | M/25 |
| 14-CG-Pancreas | CG-255-2 | Ichilov | Pancreas | PM | M/75 |
| 15-B-Lung | A409363 | Biochain | Lung | PM | F/26 |
| 16-Am-Lung (L93) | 111P0103A | Ambion | Lung | PM | F/61 |
| 17-B-Lung (L92) | A503204 | Biochain | Lung | PM | M/28 |
| 18-Am-Ovary (O47) | 061P43A | Ambion | Ovary | PM | F/16 |
| 19-B-Ovary (O48) | A504087 | Biochain | Ovary | PM | F/51 |
| 20-B-Ovary (O46) | A504086 | Biochain | Ovary | PM | F/41 |
| 21-Am-Cervix | 101P0101A | Ambion | Cervix | PM | F/40 |
| 22-B-Cervix | A408211 | Biochain | Cervix | PM | F/36 |
| 23-B-Cervix | A504089 | Biochain | Cervix | PM-Pool of 5 | M&F |
| 24-B-Uterus | A411074 | Biochain | Uterus | PM-Pool of 10 | M&F |
| 25-B-Uterus | A409248 | Biochain | Uterus | PM | F/43 |

TABLE 3-continued

Tissue samples in normal panel:

| | Lot no. | Source | Tissue | Pathology | Sex/Age |
|---|---|---|---|---|---|
| 26-B-Uterus | A504090 | Biochain | Uterus | PM-Pool of 5 | M&F |
| 27-B-Bladder | A501157 | Biochain | Bladder | PM | M/29 |
| 28-Am-Bladder | 071P02C | Ambion | Bladder | PM | M/20 |
| 29-B-Bladder | A504088 | Biochain | Bladder | PM-Pool of 5 | M&F |
| 30-Am-Placenta | 021P33A | Ambion | Placenta | PB | F/33 |
| 31-B-Placenta | A410165 | Biochain | Placenta | PB | F/26 |
| 32-B-Placenta | A411073 | Biochain | Placenta | PB-Pool of 5 | M&F |
| 33-B-Breast (B59) | A607155 | Biochain | Breast | PM | F/36 |
| 34-Am-Breast (B63) | 26486 | Ambion | Breast | PM | F/43 |
| 35-Am-Breast (B64) | 23036 | Ambion | Breast | PM | F/57 |
| 36-Cl-Prostate (P53) | 1070317 | Clontech | Prostate | PB-Pool of 47 | M&F |
| 37-Am-Prostate (P42) | 061P04A | Ambion | Prostate | PM | M/47 |
| 38-Am-Prostate (P59) | 25955 | Ambion | Prostate | PM | M/62 |
| 39-Am-Testis | 111P0104A | Ambion | Testis | PM | M/25 |
| 40-B-Testis | A411147 | Biochain | Testis | PM | M/74 |
| 41-Cl-Testis | 1110320 | Clontech | Testis | PB-Pool of 45 | M&F |
| 42-CG-Adrenal | CG-184-10 | Ichilov | Adrenal | PM | F/81 |
| 43-B-Adrenal | A610374 | Biochain | Adrenal | PM | F/83 |
| 44-B-Heart | A411077 | Biochain | Heart | PB-Pool of 5 | M&F |
| 45-CG-Heart | CG-255-9 | Ichilov | Heart | PM | M/75 |
| 46-CG-Heart | CG-227-1 | Ichilov | Heart | PM | F/36 |
| 47-Am-Liver | 081P0101A | Ambion | Liver | PM | M/64 |
| 48-CG-Liver | CG-93-3 | Ichilov | Liver | PM | F/19 |
| 49-CG-Liver | CG-124-4 | Ichilov | Liver | PM | F/34 |
| 50-Cl-BM | 1110932 | Clontech | Bone Marrow | PM-Pool of 8 | M&F |
| 51-CGEN-Blood | WBC#5 | CGEN | Blood | | M |
| 52-CGEN-Blood | WBC#4 | CGEN | Blood | | M |
| 53-CGEN-Blood | WBC#3 | CGEN | Blood | | M |
| 54-CG-Spleen | CG-267 | Ichilov | Spleen | PM | F/25 |
| 55-CG-Spleen | 111P0106B | Ambion | Spleen | PM | M/25 |
| 56-CG-Spleen | A409246 | Biochain | Spleen | PM | F/12 |
| 56-CG-Thymus | CG-98-7 | Ichilov | Thymus | PM | F/28 |
| 58-Am-Thymus | 101P0101A | Ambion | Thymus | PM | M/14 |
| 59-B-Thymus | A409278 | Biochain | Thymus | PM | M/28 |
| 60-B-Thyroid | A610287 | Biochain | Thyroid | PM | M/27 |
| 61-B-Thyroid | A610286 | Biochain | Thyroid | PM | M/24 |
| 62-CG-Thyroid | CG-119-2 | Ichilov | Thyroid | PM | F/66 |
| 63-Cl-Salivary Gland | 1070319 | Clontech | Salivary Gland | PM-Pool of 24 | M&F |
| 64-Am-Kidney | 111P0101B | Ambion | Kidney | PM-Pool of 14 | M&F |
| 65-Cl-Kidney | 1110970 | Clontech | Kidney | PM-Pool of 14 | M&F |
| 66-B-Kidney | A411080 | Biochain | Kidney | PM-Pool of 5 | M&F |
| 67-CG-Cerebellum | CG-183-5 | Ichilov | Cerebellum | PM | M/74 |
| 68-CG-Cerebellum | CG-212-5 | Ichilov | Cerebellum | PM | M/54 |
| 69-B-Brain | A411322 | Biochain | Brain | PM | M/28 |
| 70-Cl-Brain | 1120022 | Clontech | Brain | PM-Pool of 2 | M&F |
| 71-B-Brain | A411079 | Biochain | Brain | PM-Pool of 2 | M&F |
| 72-CG-Brain | CG-151-1 | Ichilov | Brain | PM | F/86 |
| 73-Am-Skeletal Muscle | 101P013A | Ambion | Skeletal Muscle | PM | F/28 |
| 74-Cl-Skeletal Muscle | 1061038 | Clontech | Skeletal Muscle | PM-Pool of 2 | M&F |

Materials and Experimental Procedures

RNA preparationRNA was obtained from Clontech (Franklin Lakes, N.J. USA 07417, dot clontech dot com), BioChain Inst. Inc. (Hayward, Calif. 94545 USA dot biochain dot com), ABS (Wilmington, Del. 19801, USA, dot absbioreagents dot com) or Ambion (Austin, Tex. 78744 USA, dot ambion dot com). Alternatively, RNA was generated from tissue samples using TRI-Reagent (Molecular Research Center), according to Manufacturer's instructions. Tissue and RNA samples were obtained from patients or from postmortem. Total RNA samples were treated with ONaseI (Ambion) and purified using RNeasy columns (Qiagen).

RT PCR—Purified RNA (1 µg) was mixed with 150 ng Random Hexamer primers (Invitrogen) and 500 µM dNTP in a total volume of 15.6 µl. The mixture was incubated for 5 min at 65° C. and then quickly chilled on ice. Thereafter, 5 µl of 5× SuperscriptII first strand buffer (Invitrogen), 2.4 µl 0.1M DTT and 40 units RNasin (Promega) were added, and the mixture was incubated for 10 min at 25° C., followed by further incubation at 42° C. for 2 min. Then, 1 µl (200 units) of SuperscriptII (Invitrogen) was added and the reaction (final volume of 25 µl) was incubated for 50 min at 42° C. and then inactivated at 70° C. for 15 min. The resulting cDNA was diluted 1:20 in TE buffer (10 mM Tris pH=8, 1 mM EDTA pH=8).

Real-Time RT-PCR analysis—cDNA (5 µl), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50° C. for 2 min, 95° C. for 10 min, and then 40 cycles of 95° C. for 15 sec, followed by 60° C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation $Q = \text{efficiency}^{-Ct}$. The efficiency of the PCR reaction was calculated from a standard curve, created by using serial dilutions of several reverse transcription (RT) reactions. To minimize inherent differences in the RT reaction, the resulting relative quantities were normalized to the geometric mean of the relative quantities of several housekeeping (HSKP) genes. Schematic summary of quantitative real-time PCR analysis is presented in FIG. 3. As shown, the x-axis shows the cycle number. The $C_T$=Threshold Cycle point, which is the cycle that the amplification curve crosses the fluorescence threshold that was set in the experiment. This point is a calculated cycle number in which PCR product signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples in testing panel were as follows:

```
Ubiquitin (GenBank Accession No. BC000449 (SEQ ID NO: 1711))

Ubiquitin Forward primer:              (SEQ ID NO: 326)
ATTTGGGTCGCGGTTCTTG

Ubiquitin Reverse primer:              (SEQ ID NO: 327)
TGCCTTGACATTCTCGATGGT

Ubiquitin-amplicon                     (SEQ ID NO: 328)
ATTTGGGTCGCGGTTCTTGTTTGTGGATCGCTGTGATCGTCACTTGACAATGCAGAT

CTTCGTGAAGACTCTGACTGGTAAGACCATCACCCTCGAGG

TTGAGCCCAGTGACACCATCGAGAATGTCAAGGCA

SDHA (GenBank Accession No. NM_004168  (SEQ ID NO: 1712))

SDHA Forward primer:                   (SEQ ID NO: 329)
TGGGAACAAGAGGGCATCTG

SDHA Reverse primer:                   (SEQ ID NO: 330)
CCACCACTGCATCAAATTCATG

SDHA-amplicon:                         (SEQ ID NO: 331)
TGGGAACAAGAGGGCATCTGCTAAAGTTTCAGATTCCATTTCTGCTCAGTATCCAGT

AGTGGATCATGAATTTGATGCAGTGGTGG

PBGD (GenBank Accession No. BC019323,  (SEQ ID NO: 1713))

PBGD Forward primer:                   (SEQ ID NO: 332)
TGAGAGTGATTCGCGTGGG

PBGD Reverse primer:                   (SEQ ID NO: 333)
CCAGGGTACGAGGCTTTCAAT

PBGD-amplicon:                         (SEQ ID NO: 334)
TGAGAGTGATTCGCGTGGGTACCCGCAAGAGCCAGCTTGCTCGCATACAGACGGAC

AGTGTGGTGGCAACATTGAAAGCCTCGTACCCTGG

HPRT1 (GenBank Accession No. NM_000194, (SEQ ID NO: 1714))

HPRT1 Forward primer:                  (SEQ ID NO: 1295)
TGACACTGGCAAAACAATGCA

HPRT1 Reverse primer:                  (SEQ ID NO: 1296)
GGTCCTTTTCACCAGCAAGCT

HPRT1-amplicon:                        (SEQ ID NO: 1297)
TGACACTGGCAAAACAATGCAGACTTTGCTTTCCTTGGTCAGGCAGTATAATCCAA

AGATGGTCAAGGTCGCAAGCTTGCTGGTGAAAAGGACC
```

The sequences of the housekeeping genes measured in all the examples on normal tissue samples panel were as follows:

```
        RPL19 (GenBank Accession No. NM_000981,   (SEQ ID NO: 1715))

RPL19 Forward primer:                             (SEQ ID NO: 1298)
TGGCAAGAAGAAGGTCTGGTTAG RPL19 Reverse primer:                             (SEQ ID NO: 1420)
TGATCAGCCCATCTTTGATGAG RPL19-amplicon:                                   (SEQ ID NO: 1630)
TGGCAAGAAGAAGGTCTGGTTAGACCCCAATGAGACCAATGAAATCGCCAATGCCA

ACTCCCGTCAGCAGATCCGGAAGCTCATCAAAGATGGGCTGATCA

TATA box (GenBank Accession No. NM_003194, (SEQ ID NO: 1716))

TATA box Forward primer:                          (SEQ ID NO: 1631)
CGGTTTGCTGCGGTAATCAT TATA box Reverse primer:                          (SEQ ID NO: 1632)
TTTCTTGCTGCCAGTCTGGAC TATA box-amplicon:                                (SEQ ID NO: 1633)
CGGTTTGCTGCGGTAATCATGAGGATAAGAGAGCCACGAACCACGGCACTGATTTT

CAGTTCTGGGAAAATGGTGTGCACAGGAGCCAAGAGTGAAGAACAGTCCAGACTG

GCAGCAAGAAA

Ubiquitin (GenBank Accession No. BC000449         (SEQ ID NO: 1711))

Ubiquitin Forward primer:                         (SEQ ID NO: 326)
ATTTGGGTCGCGGTTCTTG Ubiquitin Reverse primer:                         (SEQ ID NO: 327)
TGCCTTGACATTCTCGATGGT Ubiquitin-amplicon                                (SEQ ID NO: 328)
ATTTGGGTCGCGGTTCTTGTTTGTGGATCGCTGTGATCGTCACTTGACAATGCAGAT

CTTCGTGAAGACTCTGACTGGTAAGACCATCACCCTCGAGG

TTGAGCCCAGTGACACCATCGAGAATGTCAAGGCA

SDHA (GenBank Accession No. NM_004168             (SEQ ID NO: 1712))

SDHA Forward primer:                              (SEQ ID NO: 329)
TGGGAACAAGAGGGCATCTG SDHA Reverse primer:                              (SEQ ID NO: 330)
CCACCACTGCATCAAATTCATG SDHA-amplicon:                                    (SEQ ID NO: 331)
TGGGAACAAGAGGGCATCTGCTAAAGTTTCAGATTCCATTTCTGCTCAGTATCCAGT

AGTGGATCATGAATTTGATGCAGTGGTGG
```

Oligonucleotide-based Micro-array Experiment Protocol

Microarray Fabrication

Microarrays (chips) were printed by pin deposition using the MicroGrid II MGII 600 robot from BioRobotics Limited (Cambridge, UK). 50-mer oligonucleotides target sequences were designed by Compugen Ltd (Tel-Aviv, IL) as described by A. Shoshan et al, "Optical technologies and informatics", Proceedings of SPIE. Vol 4266, pp. 86-95 (2001). The designed oligonucleotides were synthesized and purified by desalting with the Sigma-Genosys system (The Woodlands, Tex., US) and all of the oligonucleotides were joined to a C6 amino-modified linker at the 5' end, or being attached directly to CodeLink slides (Cat #25-6700-01. Amersham Bioscience, Piscataway, N.J., US). The 50-mer oligonucleotides, forming the target sequences, were first suspended in Ultrapure DDW (Cat # 01-866-1A Kibbutz Beit-Haemek, Israel) to a concentration of 50 µM. Before printing the slides, the oligonucleotides were resuspended in 300 mM sodium phosphate (pH 8.5) to final concentration of 150 mM and printed at 35-40% relative humidity at 21° C.

Each slide contained a total of 9792 features in 32 subarrays. Of these features, 4224 features were sequences of interest according to the present invention and negative controls that were printed in duplicate. An additional 288 features (96 target sequences printed in triplicate) contained housekeeping genes from Human Evaluation Library2, Compugen Ltd, Israel. Another 384 features are E. coli spikes 1-6, which are oligos to E. Coli genes which are commercially available in the Array Control product (Array control—sense oligo spots, Ambion Inc. Austin, Tex. Cat #1781, Lot #112K06).

Post-coupling Processing of Printed Slides

After the spotting of the oligonucleotides to the glass (CodeLink) slides, the slides were incubated for 24 hours in a sealed saturated NaCl humidification chamber (relative humidity 70-75%).

Slides were treated for blocking of the residual reactive groups by incubating them in blocking solution at 50° C. for 15 minutes (10 ml/slide of buffer containing 0.1M Tris, 50 mM ethanolamine, 0.1% SDS). The slides were then rinsed twice with Ultra-pure DDW (double distilled water). The slides were then washed with wash solution (10 ml/slide. 4×SSC, 0.1% SDS)) at 50° C. for 30 minutes on the shaker. The slides were then rinsed twice with Ultra-pure DDW, followed by drying by centrifugation for 3 minutes at 800 rpm.

Next, in order to assist in automatic operation of the hybridization protocol, the slides were treated with Ventana Discovery hybridization station barcode adhesives. The printed slides were loaded on a Bio-Optica (Milan, Italy) hematology staining device and were incubated for 10 minutes in 50 ml of 3-Aminopropyl Triethoxysilane (Sigma A3648 lot #122K589). Excess fluid was dried and slides were then incubated for three hours in 20 mm/Hg in a dark vacuum desiccator (Pelco 2251, Ted Pella, Inc. Redding Calif.).

The following protocol was then followed with the Genisphere 900-RP (random primer), with mini elute columns on the Ventana Discovery HybStation™, to perform the microarray experiments. Briefly, the protocol was performed as described with regard to the instructions and information provided with the device itself. The protocol included cDNA synthesis and labeling. cDNA concentration was measured with the TBS-380 (Turner Biosystems. Sunnyvale, Calif.) PicoFlour, which is used with the OliGreen ssDNA Quantitation reagent and kit.

Hybridization was performed with the Ventana Hybridization device, according to the provided protocols (Discovery Hybridization Station Tuscon Ariz.).

The slides were then scanned with GenePix 4000B dual laser scanner from Axon Instruments Inc, and analyzed by GenePix Pro 5.0 software.

Schematic summary of the oligonucleotide based microarray fabrication and the experimental flow is presented in FIGS. 4 and 5.

Briefly, as shown in FIG. 4, DNA oligonucleotides at 25 uM were deposited (printed) onto Amersham 'CodeLink' glass slides generating a well defined 'spot'. These slides are covered with a long-chain, hydrophilic polymer chemistry that creates an active 3-D surface that covalently binds the DNA oligonucleotides 5'-end via the C6-amine modification. This binding ensures that the full length of the DNA oligonucleotides is available for hybridization to the cDNA and also allows lower background, high sensitivity and reproducibility.

FIG. 5 shows a schematic method for performing the microarray experiments. It should be noted that stages on the left-hand or right-hand side may optionally be performed in any order, including in parallel, until stage 4 (hybridization). Briefly, on the left-hand side, the target oligonucleotides are being spotted on a glass microscope slide (although optionally other materials could be used) to form a spotted slide (stage 1). On the right hand side, control sample RNA and cancer sample RNA are Cy3 and Cy5 labeled, respectively (stage 2), to form labeled probes. It should be noted that the control and cancer samples come from corresponding tissues (for example, normal prostate tissue and cancerous prostate tissue). Furthermore, the tissue from which the RNA was taken is indicated below in the specific examples of data for particular clusters, with regard to overexpression of an oligonucleotide from a "chip" (microarray), as for example "prostate" for chips in which prostate cancerous tissue and normal tissue were tested as described above. In stage 3, the probes are mixed. In stage 4, hybridization is performed to form a processed slide. In stage 5, the slide is washed and scanned to form an image file, followed by data analysis in stage 6.

The following clusters were found to be overexpressed in lung cancer:
W60282_PEA_1
F05068_PEA_1
H38804_PEA_1
HSENA78
T39971
(R00299)
H14624
Z41644_PEA_1
Z25299_PEA_2
HSSTROL3
HUMTREFAC_PEA_2
HSS100PCB
HSU33147_PEA_1
HUMCA1XIA
H61775
HUMGRP5E
HUMODCA
AA161187
R66178
D56406_PEA_1
M85491_PEA_1
Z21368_PEA_1
HUMCA1XIA
R20779
R38144_PEA_2

Z44808_PEA_1
HUMOSTRO_PEA_1_PEA_1
R11723_PEA_3
AI076020
T23580
M79217_PEA_1
M62096_PEA_1
M78076_PEA_1
T99080_PEA_4
T08446_PEA_1
R16276_PEA_1

The following clusters were found to be overexpressed in lung small cell cancer:
H61775
HUMGRP5E
M85491_PEA_1
Z44808_PEA_1
AA161187
R66178
HUMPHOSLIP_PEA_2
AI076020
T23580
M79217_PEA_1
M62096_PEA_1
M78076_PEA_1
T99080_PEA_4
T08446_PEA_1

The following clusters were found to be overexpressed in lung adenocarcinoma:
R00299
M85491_PEA_1
Z21368_PEA_1
HUMCA1 XIA
AA161187
R66178
T11628_PEA_1

The following clusters were found to be overexpressed in lung squamous cell:
HUMODCA
R00299
D56406_PEA_1
Z44808_PEA_1
Z21368_PEA_1
HUMCA1XIA
AA161187
R66178
HUMCEA_PEA_1
R35137_PEA_1_PEA_1_PEA_1

Description for Cluster H61775

Cluster H61775 features 2 transcript(s) and 6 segment(s) of interest, the names for which are given in Tables 4 and 5, respectively, the sequences themselves are given at the end of the application. The selected protein variants are given in table 6.

TABLE 4

Transcripts of interest

| Transcript Name | Sequence ID No. |
|---|---|
| H61775_T21 | 1 |
| H61775_T22 | 2 |

TABLE 5

Segments of interest

| Segment Name | Sequence ID No. |
|---|---|
| H61775_node_2 | 151 |
| H61775_node_4 | 152 |
| H61775_node_6 | 153 |
| H61775_node_8 | 154 |
| H61775_node_0 | 155 |
| H61775_node_5 | 156 |

TABLE 6

Proteins of interest

| Protein Name | Sequence ID No. |
|---|---|
| H61775_P16 | 1281 |
| H61775_P17 | 1282 |

Cluster H61775 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 6 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 6 and Table 7. This cluster is overexpressed (at least at a minimum level) in the following pathological conditions: brain malignant tumors and a mixture of malignant tumors from different tissues.

TABLE 7

Normal tissue distribution

| Name of Tissue | Number |
|---|---|
| bladder | 0 |
| brain | 0 |
| colon | 0 |
| epithelial | 10 |
| general | 3 |
| breast | 8 |
| muscle | 0 |
| ovary | 0 |
| pancreas | 0 |
| prostate | 0 |
| uterus | 0 |

TABLE 8

P values and ratios for expression in cancerous tissue

| Name of Tissue | P1 | P2 | SP1 | R3 | SP2 | R4 |
|---|---|---|---|---|---|---|
| bladder | 3.1e−01 | 3.8e−01 | 3.2e−01 | 2.5 | 4.6e−01 | 1.9 |
| brain | 8.8e−02 | 6.5e−02 | 1 | 3.5 | 4.1e−04 | 5.8 |
| colon | 5.6e−01 | 6.4e−01 | 1 | 1.1 | 1 | 1.1 |
| epithelial | 3.0e−02 | 1.3e−01 | 2.3e−02 | 2.1 | 3.2e−01 | 1.2 |
| general | 1.3e−06 | 4.9e−05 | 1.0e−07 | 6.3 | 1.5e−06 | 4.3 |
| breast | 4.7e−01 | 3.7e−01 | 3.3e−01 | 2.0 | 4.6e−01 | 1.6 |
| muscle | 2.3e−01 | 2.9e−01 | 1.5e−01 | 6.8 | 3.9e−01 | 2.6 |
| ovary | 3.8e−01 | 4.2e−01 | 1.5e−01 | 2.4 | 2.6e−01 | 1.9 |
| pancreas | 3.3e−01 | 4.4e−01 | 4.2e−01 | 2.4 | 5.3e−01 | 1.9 |

TABLE 8-continued

P values and ratios for expression in cancerous tissue

| Name of Tissue | P1 | P2 | SP1 | R3 | SP2 | R4 |
|---|---|---|---|---|---|---|
| prostate | 7.3e−01 | 7.8e−01 | 6.7e−01 | 1.5 | 7.5e−01 | 1.3 |
| uterus | 1.0e−01 | 2.6e−01 | 2.9e−01 | 2.6 | 5.1e−01 | 1.8 |

As noted above, contig H61775 features 2 transcript(s), which were listed in Table 3 above. A description of each variant protein according to the present invention is now provided.

Variant protein H61775_P16 (SEQ ID NO:1281) according to the present invention has an amino acid sequence as given at the end of the application; it is encoded by transcript(s) H61775_T21 (SEQ ID NO:1). One or more alignments to one or more previously published protein sequences are given at the end of the application. A brief description of the relationship of the variant protein according to the present invention to each such aligned protein is as follows:

Comparison Report Between H61775_P16 (SEQ ID NO:1281) and Q9P2J2 (SEQ ID NO:1694):

1. An isolated chimeric polypeptide encoding for H61775_P16 (SEQ ID NO:1281), comprising a first amino acid sequence being at least 90% homologous to MVW-CLGLAVLSLVISQGADGRGKPEVVSV-VGRAGESVVLGCDLLPPAGRPPLHVIEWL RFGFLLPI-FIQFGLYSPRIDPDYVG corresponding to amino acids 11-93 of Q9P2J2 (SEQ ID NO:1694), which also corresponds to amino acids 1-83 of H61775_P16 (SEQ ID NO:1281), and a second amino acid sequence being at least 70%, optionally at least 80%, preferably at least 85%, more preferably at least 90% and most preferably at least 95% homologous to a polypeptide having the sequence DCGFPAFRELKRA-ETVSPVFFTRRCIWEDLKSTGF-SPAGGGRPPGGGPRTQEDSGLPCW RSSCSVTLQV (SEQ ID NO: 1754) corresponding to amino acids 84-152 of H61775_P16 (SEQ ID NO:1281), wherein said first and second amino acid sequences are contiguous and in a sequential order.

2. An isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO:1754) in H61775_P16 (SEQ ID NO:1281).

Comparison Report Between H61775_P16 (SEQ ID NO:1281) and AAQ88495 (SEQ ID NO:1695):

1. An isolated chimeric polypeptide encoding for H61775_P16 (SEQ ID NO:1281), comprising a first amino acid sequence being at least 90% homologous to MVW-CLGLAVLSLVISQGADGRGKPEVVSV-VGRAGESVVLGCDLLPPAGRPPLHVIEWL RFGFLLPI-FIQFGLYSPRIDPDYVG corresponding to amino acids 1-83 of AAQ88495 (SEQ ID NO:1695), which also corresponds to amino acids 1-83 of H61775_P16 (SEQ ID NO:1281), and a second amino acid sequence being at least 70%, optionally at least 80%, preferably at least 85%, more preferably at least 90% and most preferably at least 95% homologous to a polypeptide having the sequence DCGFPAFRELKRA-ETVSPVFFTRRCIWEDLKSTGF-SPAGGGRPPGGGPRTQEDSGLPCW RSSCSVTLQV (SEQ ID NO:1754) corresponding to amino acids 84-152 of H61775_P16 (SEQ ID NO:1281), wherein said first and second amino acid sequences are contiguous and in a sequential order.

2. An isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIW-EDLKSTGFSPAGGGRPPGGGPRTQEDSGLPCW RSSCSVTLQV (SEQ ID NO:1754) in H61775_P16 (SEQ ID NO:1281).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H61775_P16 (SEQ ID NO:1281) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein H61775_P16 (SEQ ID NO:1281) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 14 | I -> T | No |
| 138 | G -> R | No |
| 34 | G -> E | Yes |
| 48 | G -> R | No |
| 91 | R -> * | Yes |

Variant protein H61775_P16 (SEQ ID NO:1281) is encoded by the following transcript(s): H61775_T21 (SEQ ID NO:1), for which the sequence(s) is/are given at the end of the application. The coding portion of transcript H61775_T21 (SEQ ID NO:1) is shown in bold; this coding portion starts at position 261 and ends at position 716. The transcript also has the following SNPs as listed in Table 10 (given according to their position on the nucleotide sequence, with the alternative nucleic acid listed; the last column indicates whether the SNP is known or not; the presence of known SNPs in variant protein H61775_P16 (SEQ ID NO:1281) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 117 | T -> C | Yes |
| 200 | T -> C | No |

TABLE 10-continued

Nucleic acid SNPs

| SNP position on nucleotide sequence | Alternative nucleic acid | Previously known SNP? |
|---|---|---|
| 672 | G -> C | No |
| 222 | T -> C | Yes |
| 301 | T -> C | No |
| 361 | G -> A | Yes |
| 377 | G -> A | No |
| 400 | -> C | No |
| 402 | G -> C | No |
| 531 | C -> T | Yes |
| 566 | T -> C | No |

Variant protein H61775_P17 (SEQ ID NO:1282) according to the present invention has an amino acid sequence as given at the end of the application; it is encoded by transcript(s) H61775_T22 (SEQ ID NO:2). One or more alignments to one or more previously published protein sequences are given at the end of the application. A brief description of the relationship of the variant protein according to the present invention to each such aligned protein is as follows:

Comparison Report Between H61775_P17 (SEQ ID NO:1282) and Q9P2J2 (SEQ ID NO:1694):

1. An isolated chimeric polypeptide encoding for H61775_P17 (SEQ ID NO:1282), comprising a first amino acid sequence being at least 90% homologous to MVWCLGLAVLSLVISQGADGRGKPEVVSV-VGRAGESVVLGCDLLPPAGRPPLHVIEWL RFGFLLPI-FIQFGLYSPRIDPDYVG corresponding to amino acids 11-93 of Q9P2J2 (SEQ ID NO:1694), which also corresponds to amino acids 1-83 of H61775_P17 (SEQ ID NO:1282).

Comparison Report Between H61775_P17 (SEQ ID NO:1282) and AAQ88495 (SEQ ID NO:1695):

1. An isolated chimeric polypeptide encoding for H61775_P17 (SEQ ID NO:1282), comprising a first amino acid sequence being at least 90% homologous to MVWCLGLAVLSLVISQGADGRGKPEVVSV-VGRAGESVVLGCDLLPPAGRPPLHVIEWL RFGFLLPI-FIQFGLYSPRIDPDYVG corresponding to amino acids 1-83 of AAQ88495 (SEQ ID NO:1695), which also corresponds to amino acids 1-83 of H61775_P17 (SEQ ID NO:1282).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H61775_P17 (SEQ ID NO:1282) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein H61775_P17 (SEQ ID NO:1282) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 14 | I -> T | No |
| 34 | G -> E | Yes |
| 48 | G -> R | No |

Variant protein H61775_P17 (SEQ ID NO:1282) is encoded by the following transcript(s): H61775_T22 (SEQ ID NO:2), for which the sequence(s) is/are given at the end of the application. The coding portion of transcript H61775_T22 (SEQ ID NO:2) is shown in bold; this coding portion starts at position 261 and ends at position 509. The transcript also has the following SNPs as listed in Table 12 (given according to their position on the nucleotide sequence, with the alternative nucleic acid listed; the last column indicates whether the SNP is known or not; the presence of known SNPs in variant protein H61775_P17 (SEQ ID NO:1282) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 117 | T -> C | Yes |
| 200 | T -> C | No |
| 222 | T -> C | Yes |
| 301 | T -> C | No |
| 361 | G -> A | Yes |
| 377 | G -> A | No |
| 400 | -> C | No |
| 402 | G -> C | No |
| 596 | T -> A | Yes |

As noted above, cluster H61775 features 6 segment(s), which were listed in Table 4 above and for which the sequence(s) are given at the end of the application. These segment(s) are portions of nucleic acid sequence(s) which are described herein separately because they are of particular interest. A description of each segment according to the present invention is now provided.

Segment cluster H61775_node_2 (SEQ ID NO:1022) according to the present invention is supported by 17 libraries. The number of libraries was determined as previously described. This segment can be found in the following transcript(s): H61775_T21 (SEQ ID NO:1) and H61775_T22 (SEQ ID NO:2). Table 13 below describes the starting and ending position of this segment on each transcript.

TABLE 13

Segment location on transcripts

| Transcript name | Segment starting position | Segment ending position |
|---|---|---|
| H61775_T21 (SEQ ID NO: 1) | 87 | 318 |
| H61775_T22 (SEQ ID NO: 2) | 87 | 318 |

Segment cluster H61775_node_4 (SEQ ID NO:1023) according to the present invention is supported by 20 libraries. The number of libraries was determined as previously described. This segment can be found in the following transcript(s): H61775_T21 (SEQ ID NO:1) and H61775_T22 (SEQ ID NO:2). Table 14 below describes the starting and ending position of this segment on each transcript.

TABLE 14

Segment location on transcripts

| Transcript name | Segment starting position | Segment ending position |
|---|---|---|
| H61775_T21 (SEQ ID NO: 1) | 319 | 507 |
| H61775_T22 (SEQ ID NO: 2) | 319 | 507 |

Segment cluster H61775_node_6 (SEQ ID NO:1024) according to the present invention is supported by 1 libraries. The number of libraries was determined as previously described. This segment can be found in the following transcript(s): H61775_T22 (SEQ ID NO:2). Table 15 below describes the starting and ending position of this segment on each transcript.

TABLE 15

Segment location on transcripts

| Transcript name | Segment starting position | Segment ending position |
|---|---|---|
| H61775_T22 (SEQ ID NO: 2) | 515 | 715 |

Segment cluster H61775_node_8 (SEQ ID NO:1025) according to the present invention is supported by 5 libraries. The number of libraries was determined as previously described. This segment can be found in the following transcript(s): H61775_T21 (SEQ ID NO:1). Table 16 below describes the starting and ending position of this segment on each transcript.

TABLE 16

Segment location on transcripts

| Transcript name | Segment starting position | Segment ending position |
|---|---|---|
| H61775_T21 (SEQ ID NO: 1) | 508 | 1205 |

According to an optional embodiment of the present invention, short segments related to the above cluster are also provided. These segments are up to about 120 bp in length, and so are included in a separate description.

Segment cluster H61775_node_0 (SEQ ID NO:1026) according to the present invention is supported by 4 libraries. The number of libraries was determined as previously described. This segment can be found in the following transcript(s): H61775_T21 (SEQ ID NO:1) and H61775_T22 (SEQ ID NO:2). Table 17 below describes the starting and ending position of this segment on each transcript.

TABLE 17

Segment location on transcripts

| Transcript name | Segment starting position | Segment ending position |
|---|---|---|
| H61775_T21 (SEQ ID NO: 1) | 1 | 86 |
| H61775_T22 (SEQ ID NO: 2) | 1 | 86 |

Segment cluster H61775_node_5 (SEQ ID NO:1027) according to the present invention can be found in the following transcript(s): H61775_T22 (SEQ ID NO:2). Table 18 below describes the starting and ending position of this segment on each transcript.

TABLE 18

Segment location on transcripts

| Transcript name | Segment starting position | Segment ending position |
|---|---|---|
| H61775_T22 (SEQ ID NO: 2) | 508 | 514 |

Microarray (chip) data is also available for this gene as follows. As described above with regard to the cluster itself, various oligonucleotides were tested for being differentially expressed in various disease conditions, particularly cancer. The following oligonucleotides were found to hit this segment (with regard to lung cancer), shown in Table 19.

TABLE 19

Oligonucleotides related to this gene

| Oligonucleotide name | Overexpressed in cancers | Chip reference |
|---|---|---|
| H61775_0_11_0 | Lung cancer | Lung |

Variant Protein Alignment to the Previously Known Protein:

Sequence name: /tmp/Psw0RJLCti/aLAXQjXh07:Q9P2J2 (SEQ ID NO:1694)

Sequence documentation:

Alignment of: H61775_P16 (SEQ ID NO:1281) x Q9P2J2 (SEQ ID NO:1694) ..

Alignment segment 1/1:

| | | | |
|---|---|---|---|
| Quality: | 803.00 | Escore: | 0 |
| Matching length: | 83 | Total length: | 83 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MVWCLGLAVLSLVISQGADGRGKPEVVSVVGRAGESVVLGCDLLPPAGRP 50
   |||||||||||||||||||||||||||||||||||||||||||||||||
11 MVWCLGLAVLSLVISQGADGRGKPEVVSVVGRAGESVVLGCDLLPPAGRP 60

51 PLHVIEWLRFGFLLPIFIQFGLYSPRIDPDYVG                  83
   ||||||||||||||||||||||||||||||||
61 PLHVIEWLRFGFLLPIFIQFGLYSPRIDPDYVG                  93
```

Sequence name: /tmp/Psw0RJLCti/aLAXQjXh07: AAQ88495 (SEQ ID NO:1695)
Sequence documentation:
Alignment of: H61775_P16 (SEQ ID NO:1281) x AAQ88495 (SEQ ID NO:1695) ..
Alignment segment 1/1:

| | | | |
|---|---|---|---|
| Quality: | 803.00 | Escore: | 0 |
| Matching length: | 83 | Total length: | 83 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MVWCLGLAVLSLVISQGADGRGKPEVVSVVGRAGESVVLGCDLLPPAGRP 50
   |||||||||||||||||||||||||||||||||||||||||||||||||
 1 MVWCLGLAVLSLVISQGADGRGKPEVVSVVGRAGESVVLGCDLLPPAGRP 50

51 PLHVIEWLRFGFLLPIFIQFGLYSPRIDPDYVG                  83
   ||||||||||||||||||||||||||||||||
51 PLHVIEWLRFGFLLPIFIQFGLYSPRIDPDYVG                  83
```

Sequence name: /tmp/naab8yR3GC/pSM4121L5o:Q9P2J2 (SEQ ID NO:1694)
Sequence documentation:
Alignment of: H61775_P17 (SEQ ID NO:1282) x Q9P2J2 (SEQ ID NO:1694) ..
Alignment segment 1/1:

| | | | |
|---|---|---|---|
| Quality: | 803.00 | Escore: | 0 |
| Matching length: | 83 | Total length: | 83 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MVWCLGLAVLSLVISQGADGRGKPEVVSVVGRAGESVVLGCDLLPPAGRP 50
   |||||||||||||||||||||||||||||||||||||||||||||||||
11 MVWCLGLAVLSLVISQGADGRGKPEVVSVVGRAGESVVLGCDLLPPAGRP 60

51 PLHVIEWLRFGFLLPIFIQFGLYSPRIDPDYVG                  83
   ||||||||||||||||||||||||||||||||
61 PLHVIEWLRFGFLLPIFIQFGLYSPRIDPDYVG                  93
```

Sequence name: /tmp/naab8yR3GC/pSM4121L5o: AAQ88495 (SEQ ID NO:1695)
Sequence documentation:
Alignment of: H61775_P17 (SEQ ID NO:1282) x AAQ88495 (SEQ ID NO:1695) ..
Alignment segment 1/1:

| Quality: | 803.00 | Escore: | 0 |
|---|---|---|---|
| Matching length: | 83 | Total length: | 83 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MVWCLGLAVLSLVISQGADGRGKPEVVSVVGRAGESVVLGCDLLPPAGRP 50
   |||||||||||||||||||||||||||||||||||||||||||||||||
 1 MVWCLGLAVLSLVISQGADGRGKPEVVSVVGRAGESVVLGCDLLPPAGRP 50

51 PLHVIEWLRFGFLLPIFIQFGLYSPRIDPDYVG                  83
   ||||||||||||||||||||||||||||||||
51 PLHVIEWLRFGFLLPIFIQFGLYSPRIDPDYVG                  83
```

Expression of Immunoglobulin Superfamily, Member 9, H61775 Transcripts which are Detectable by Amplicon as Depicted in Sequence Name H61775seg8 (SEQ ID NO:1636) in Normal and Cancerous Lung Tissues Expression of immunoglobulin superfamily, member 9 transcripts detectable by or according to seg8, H61775seg8 amplicon (SEQ ID NO:1636) and H61775seg8F2 (SEQ ID NO: 1634) and H61775seg8R2 (SEQ ID NO:1635) primers was measured by real time PCR. In parallel the expression of four housekeeping genes—PBGD (GenBank Accession No. BC019323 (SEQ ID NO:1713); amplicon—PBGD-amplicon, SEQ ID NO:334, primers SEQ ID NOs 332 and 333), HPRT1 (GenBank Accession No. NM_000194 (SEQ ID NO:1714); amplicon—HPRT1-amplicon, SEQ ID NO:1297; primers SEQ ID NOs 1295 and 1296), Ubiquitin (GenBank Accession No. BC000449 (SEQ ID NO:1711); amplicon—Ubiquitin-amplicon, SEQ ID NO:328, primers SEQ ID NOs 326 and 327) and SDHA (GenBank Accession No. NM_004168 (SEQ ID NO:1712); amplicon—SDHA-amplicon, SEQ ID NO:331; primers SEQ ID NOs 329 and 330) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel"), to obtain a value of fold up-regulation for each sample relative to median of the normal PM samples.

FIG. 7 is a histogram showing over expression of the above-indicated immunoglobulin superfamily, member 9 transcripts in cancerous lung samples relative to the normal samples. The number and percentage of samples that exhibit at least 5 fold over-expression, out of the total number of samples tested, is indicated in the bottom.

As is evident from FIG. 7, the expression of immunoglobulin superfamily, member 9 transcripts detectable by the above amplicon(s) in cancer samples was significantly higher than in the non-cancerous samples (Sample Nos. 47-50, 90-93, 96-99, Table 2 "Tissue samples in testing panel"). Notably an over-expression of at least 5 fold was found in 11 out of 15 adenocarcinoma samples, 12 out of 16 squamous cell carcinoma samples, 1 out of 4 samples of large cell carcinoma samples and in 8 out of 8 small cell carcinoma samples.

Statistical analysis was applied to verify the significance of these results, as described below.

The P value for the difference in the expression levels of immunoglobulin superfamily, member 9 transcripts detectable by the above amplicon in lung cancer samples versus the normal tissue samples was determined by T test as 6.5E-02. In adenocarcinoma, the minimum values were 7.62E-03 in squamous cell adenocarcinoma cancer and 1.5E-03 in small cell carcinoma.

Threshold of 5 fold overexpression was found to differentiate between cancer and normal samples with P value of 9.62E-04 in adenocarcinoma, 5.9E-04 in squamous cell carcinoma, and a threshold of 10 fold overexpression was found to differentiate between small cell adenocarcinoma cancer and normal samples with P value of 7.14E-05 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: H61775seg8F2 forward primer (SEQ ID NO:1634); and H61775seg8R2 reverse primer (SEQ ID NO:1635).

The present invention also preferably encompasses any amplicon obtained through the use of any suitable primer pair; for example, for the above experiment, the following amplicon was obtained as a non-limiting illustrative example only of a suitable amplicon: H61775seg8 (SEQ ID NO:1636).

H61775seg8F2 (SEQ ID NO: 1634)
GAAGGCTCTTGTCACTTACTAGCCAT

H61775seg8R2 (SEQ ID NO: 1635)
TGTCACCATATTTAATCCTCCCAA

H61775seg8 (SEQ ID NO: 1636)
GAAGGCTCTTGTCACTTACTAGCCATGTGATTTTGGAAAGAAACTTAACATTAATTC

CTTCAGCTACAATGGAATTCTTGGGAGGATTAAATATGGTGACA

Expression of Immunoglobulin Superfamily, Member 9, H61775 Transcripts which are Detectable by Amplicon as Depicted in Sequence Name H61775seg8 (SEQ ID NO:1636) in Different Normal Tissues Expression of immunoglobulin superfamily, member 9 transcripts detectable by or according to H61775 seg8 amplicon (SEQ ID NO:1636) and H61775 seg8F2 (SEQ ID NO:1634) and H61775 seg8R2 (SEQ ID NO:1635) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon-SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 4, "Tissue sample in normal panel", above), to obtain a value of relative expression of each sample relative to median of the ovary samples.

Figure 8:
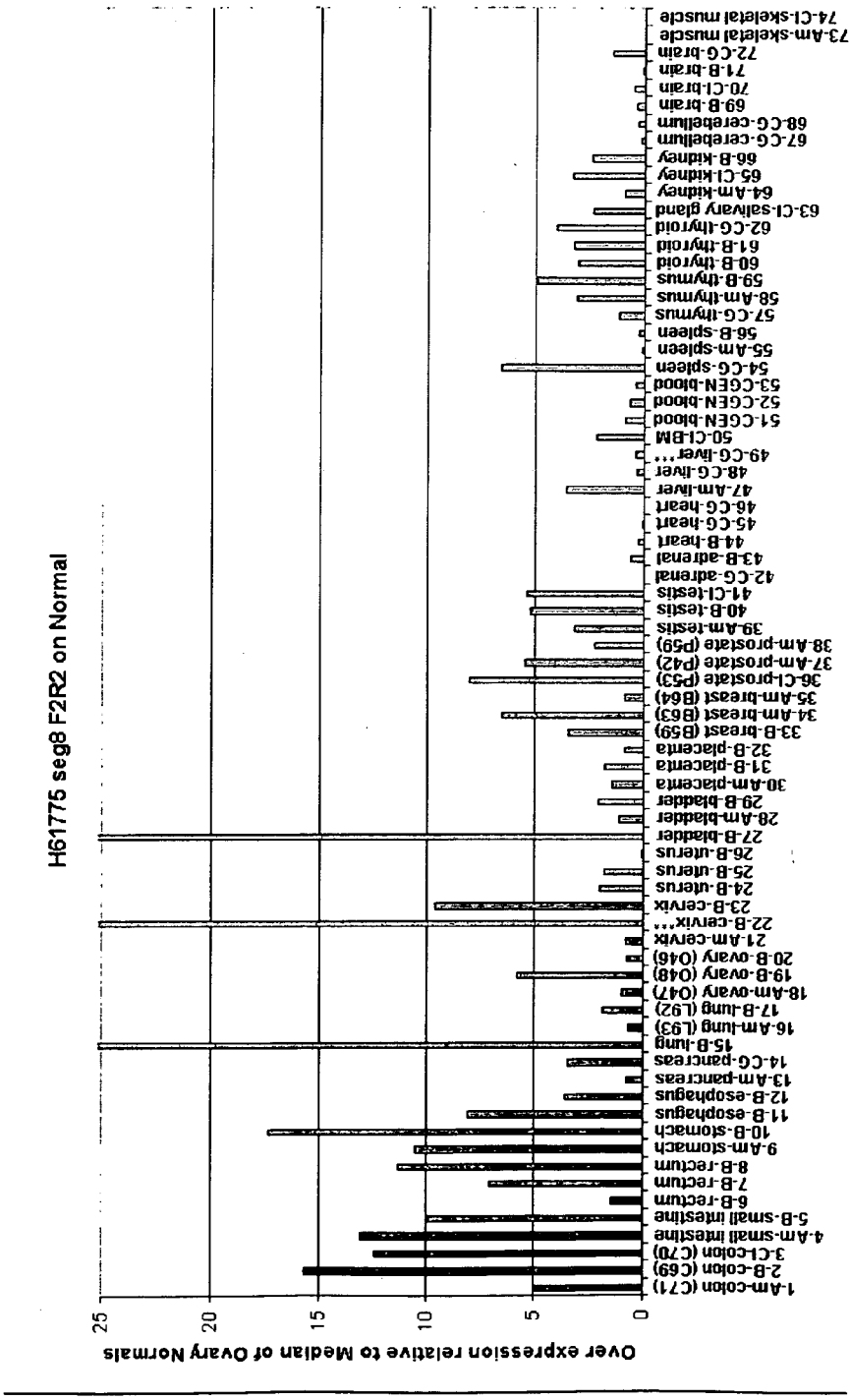
FIG. 8 is a histogram showing expression of immunoglobulin superfamily, member 9, H61775 transcripts, which are detectable by amplicon as depicted in sequence name H61775seg8 (SEQ ID NO: 1636), in different normal tissues.

H61775seg8F2 (SEQ ID NO:1634)
GAAGGCTCTTGTCACTTACTAGCCAT
H61775seg8R2 (SEQ ID NO:1635)
TGTCACCATATTTAATCCTCCCAA
H61775seg8 (SEQ ID NO:1636)
GAAGGCTCTTGTCACTTACTAGCCATGT-
GATTTTGGAAAGAAACTTAACATTAATTC
CTTCAGCTACMTGGMTTCTTGGGAGGAT-
TAAATATGGTGACA The results are demonstrated in FIG. 8, showing expression of immunoglobulin superfamily, member 9, H61775 transcripts, which are detectable by amplicon as depicted in sequence name H61775seg8 (SEQ ID NO:1636), in different normal tissues.

Description for Cluster M85491

Cluster M85491 features 2 transcript(s) and 11 segment(s) of interest, the names for which are given in Tables 20 and 21, respectively, the sequences themselves are given at the end of the application. The selected protein variants are given in table 22.

TABLE 20

Transcripts of interest

| Transcript Name | Sequence ID No. |
| --- | --- |
| M85491_PEA_1_T16 | 3 |
| M85491_PEA_1_T20 | 4 |

TABLE 21

Segments of interest

| Segment Name | Sequence ID No. |
| --- | --- |
| M85491_PEA_1_node_0 | 157 |
| M85491_PEA_1_node_13 | 158 |
| M85491_PEA_1_node_21 | 159 |
| M85491_PEA_1_node_23 | 160 |
| M85491_PEA_1_node_24 | 161 |
| M85491_PEA_1_node_8 | 162 |
| M85491_PEA_1_node_9 | 163 |
| M85491_PEA_1_node_10 | 164 |
| M85491_PEA_1_node_18 | 165 |
| M85491_PEA_1_node_19 | 166 |
| M85491_PEA_1_node_6 | 167 |

TABLE 22

Proteins of interest

| Protein Name | Sequence ID No. |
| --- | --- |
| M85491_PEA_1_P13 | 1283 |
| M85491_PEA_1_P14 | 1284 |

These sequences are variants of the known protein Ephrin type-B receptor 2 [precursor] (SwissProt accession identifier EPB2_HUMAN; known also according to the synonyms EC 2.7.1.112; Tyrosine-protein kinase receptor EPH-3; DRT; Receptor protein-tyrosine kinase HEK5; ERK), SEQ ID NO:1417, referred to herein as the previously known protein.

Protein Ephrin type-B receptor 2 [precursor] (SEQ ID NO:1417) is known or believed to have the following function(s): Receptor for members of the ephrin-B family. The sequence for protein Ephrin type-B receptor 2 [precursor] is given at the end of the application, as "Ephrin type-B receptor 2 [precursor] amino acid sequence" (SEQ ID NO:1417). Known polymorphisms for this sequence are as shown in Table 23.

TABLE 23

Amino acid mutations for Known Protein

| SNPposition(s) on amino acid sequence | Comment |
|---|---|
| 671 | A -> R. /FTId = VAR_004162. |
| 1–20 | MALRRLGAALLLLPLLAAVE -> MWVPVLALPVCTYA |
| 923 | E -> K |
| 956 | L -> V |
| 958 | V -> L |
| 154 | G -> D |
| 476 | K -> KQ |
| 495–496 | Missing |
| 532 | E -> D |
| 568 | R -> RR |
| 589 | M -> I |
| 788 | I -> F |
| 853 | S -> A |

Protein Ephrin type-B receptor 2 [precursor] (SEQ ID NO:1417) localization is believed to be Type I membrane protein.

The following GO Annotation(s) apply to the previously known protein. The following annotation(s) were found: protein amino acid phosphorylation; transmembrane receptor protein tyrosine kinase signaling pathway; neurogenesis, which are annotation(s) related to Biological Process; protein tyrosine kinase; receptor; transmembrane-ephrin receptor; ATP binding; transferase, which are annotation(s) related to Molecular Function; and integral membrane protein, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nml dot nih dot gov/projects/LocusLink/>.

Cluster M85491 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 9 refer to weighted expression of ESTs in each category, as "parts per million" (ratio of the expression of ESTs for a particular cluster to the expression of all ESTs in that category, according to parts per million).

Figure 9:
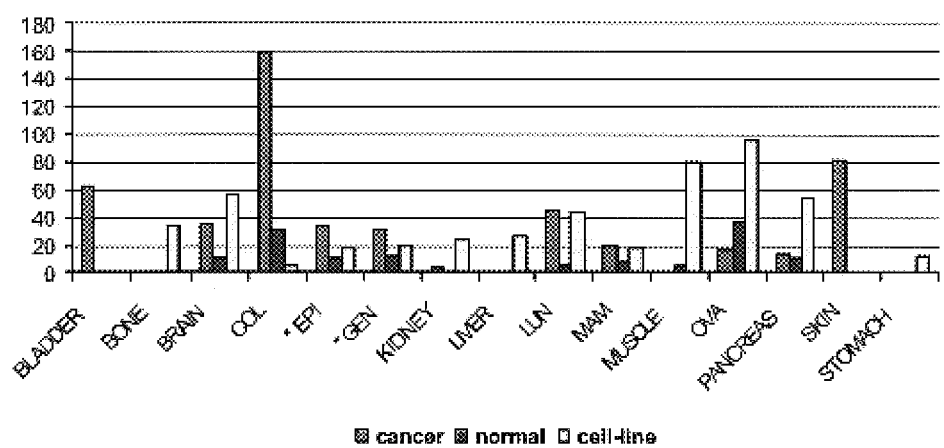
FIG. 9 is a histogram showing Cancer and cell-line vs. normal tissue expression for Cluster M85491, demonstrating overexpression in epithelial malignant tumors and a mixture of malignant tumors from different tissues.

Overall, the following results were obtained as shown with regard to the histograms in FIG. 9 and Table 24. This cluster is overexpressed (at least at a minimum level) in the following pathological conditions: epithelial malignant tumors and a mixture of malignant tumors from different tissues.

TABLE 24

Normal tissue distribution

| Name of Tissue | Number |
|---|---|
| Bladder | 0 |
| Bone | 0 |
| Brain | 10 |
| Colon | 31 |
| epithelial | 10 |
| General | 12 |
| Kidney | 0 |
| Liver | 0 |
| Lung | 5 |
| Breast | 8 |
| Muscle | 5 |
| Ovary | 36 |

TABLE 24-continued

Normal tissue distribution

| Name of Tissue | Number |
|---|---|
| pancreas | 10 |
| Skin | 0 |
| Stomach | 0 |

TABLE 25

P values and ratios for expression in cancerous tissue

| Name of Tissue | P1 | P2 | SP1 | R3 | SP2 | R4 |
|---|---|---|---|---|---|---|
| Bladder | 5.4e−01 | 6.0e−01 | 3.2e−01 | 2.5 | 4.6e−01 | 1.9 |
| Bone | 1 | 2.8e−01 | 1 | 1.0 | 7.0e−01 | 1.8 |
| Brain | 3.4e−01 | 3.6e−01 | 1.2e−01 | 2.9 | 1.8e−02 | 2.7 |
| Colon | 3.4e−02 | 5.7e−02 | 8.2e−02 | 2.8 | 2.0e−01 | 2.1 |
| epithelial | 1.7e−03 | 3.5e−03 | 2.0e−03 | 2.8 | 1.1e−02 | 2.2 |
| General | 4.8e−04 | 5.2e−04 | 6.7e−04 | 2.3 | 1.3e−03 | 1.9 |
| Kidney | 4.3e−01 | 3.7e−01 | 1 | 1.1 | 7.0e−01 | 1.5 |
| Liver | 1 | 4.5e−01 | 1 | 1.0 | 6.9e−01 | 1.5 |
| Lung | 2.2e−01 | 2.7e−01 | 6.9e−02 | 3.6 | 3.4e−02 | 3.6 |
| Breast | 8.2e−01 | 7.3e−01 | 6.9e−01 | 1.2 | 6.8e−01 | 1.2 |
| Muscle | 9.2e−01 | 4.8e−01 | 1 | 0.8 | 1.5e−01 | 3.2 |
| Ovary | 8.5e−01 | 7.3e−01 | 9.0e−01 | 0.7 | 6.7e−01 | 1.0 |
| pancreas | 5.5e−01 | 2.0e−01 | 6.7e−01 | 1.2 | 3.5e−01 | 1.8 |
| Skin | 2.9e−01 | 4.7e−01 | 1.4e−01 | 7.0 | 6.4e−01 | 1.6 |
| Stomach | 1.5e−01 | 3.2e−01 | 1 | 1.0 | 8.0e−01 | 1.3 |

As noted above, cluster M85491 features 2 transcript(s), which were listed in Table 20 above. These transcript(s) encode for protein(s) which are variant(s) of protein Ephrin type-B receptor 2 [precursor] (SEQ ID NO:1417). A description of each variant protein according to the present invention is now provided.

Variant protein M85491_PEA_1_P13 (SEQ ID NO:1283) according to the present invention has an amino acid sequence as given at the end of the application; it is encoded by transcript(s) M85491_PEA_1_T16 (SEQ ID NO:3). An alignment is given to the known protein (Ephrin type-B receptor 2 [precursor] (SEQ ID NO:1417)) at the end of the application. One or more alignments to one or more previously published protein sequences are given at the end of the application. A brief description of the relationship of the variant protein according to the present invention to each such aligned protein is as follows:

Comparison Report Between M85491_PEA_1_P13 (SEQ ID NO:1283) and EPB2_HUMAN (SEQ ID NO:1417):

1. An isolated chimeric polypeptide encoding for M85491_PEA_1_P13 (SEQ ID NO:1283), comprising a first amino acid sequence being at least 90% homologous to MALRRLGAALLLLPLLAAVEETLMDST-
TATAELGWMVHPPSGWEEVSGYDENMNTIR
TYQVCNVFESSQNNWLRTKFIR-
RRGAHRIHVEMKFSVRDCSSIPSVPGSCKETFNLYYY
EADFDSATKTFPNWMENPWVKVD-
TIAADESFSQVDLGGRVMKINTEVRSFGPVSRSGF
YLAFQDYGGCMSLIAVRVFYRKCPRI-
IQNGAIFQETLSGAESTSLVAARGSCIANAEEVD
VPIKLYCNGDGEWLVPIGRCMCKAG-
FEAVENGTVCRGCPSGTFKANQGDEACTHCPIN
SRTTSEGATNCVCRNGYYRADLDPLD-
MPCTTIPSAPQAVISSVNETSLMLEWTPPRDSG
GREDLVYNIICKSCGSGRGACTRCGDN-
VQYAPRQLGLTEPRIYISDLLAHTQYTFEIQAV NGVT- DQSPFSPQFASVNITTNQAAPSAVSIM-HQVSRTVDSITLSWSQPDQPNGVILDYEL QYYEK corresponding to amino acids 1-476 of EPB2_HUMAN (SEQ ID NO:1417), which also corresponds to amino acids 1-476 of M85491_PEA_1_P13 (SEQ ID NO:1283), and a second amino acid sequence being at least 70%, optionally at least 80%, preferably at least 85%, more preferably at least 90% and most preferably at least 95% homologous to a polypeptide having the sequence VPIGWVLSPSPTSLRA-PLPG (SEQ ID NO:1755) corresponding to amino acids 477-496 of M85491_PEA_1_P13 (SEQ ID NO:1283), wherein said first and second amino acid sequences are contiguous and in a sequential order.

2. An isolated polypeptide encoding for a tail of M85491_PEA_1_P13 (SEQ ID NO:1283), comprising a polypeptide being at least 70%, optionally at least about 80%, preferably at least about 85%, more preferably at least about 90% and most preferably at least about 95% homologous to the sequence VPIGWVLSPSPTSLRAPLPG (SEQ ID NO:1755) in M85491_PEA_1_P13 (SEQ ID NO:1283).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M85491_PEA_1_P13 (SEQ ID NO:1283) is encoded by the following transcript(s): M85491_PEA_1_T16 (SEQ ID NO:3), for which the sequence(s) is/are given at the end of the application. The coding portion of transcript M85491_PEA_1_T16 (SEQ ID NO:3) is shown in bold; this coding portion starts at position 143 and ends at position 1630. The transcript also has the following SNPs as listed in Table 26 (given according to their position on the nucleotide sequence, with the alternative nucleic acid listed; the last column indicates whether the SNP is known or not; the presence of known SNPs in variant protein M85491_PEA_1_P13 (SEQ ID NO:1283) sequence provides support for the deduced sequence of this variant protein according to the present invention).

TABLE 26

Nucleic acid SNPs

| SNP position on nucleotide sequence | Alternative nucleic acid | Previously known SNP? |
| --- | --- | --- |
| 799 | G -> A | Yes |
| 1066 | C -> T | Yes |
| 1519 | A -> G | Yes |
| 1872 | C -> T | Yes |
| 2044 | T -> C | Yes |
| 2156 | G -> A | Yes |
| 2606 | C -> A | Yes |
| 2637 | G -> C | Yes |

Variant protein M85491_PEA_1_P14 (SEQ ID NO:1284) according to the present invention has an amino acid sequence as given at the end of the application; it is encoded by transcript(s) M85491_PEA_1_T20 (SEQ ID NO:4). An alignment is given to the known protein (Ephrin type-B receptor 2 [precursor] (SEQ ID NO:1417)) at the end of the application. One or more alignments to one or more previously published protein sequences are given at the end of the application. A brief description of the relationship of the variant protein according to the present invention to each such aligned protein is as follows:

Comparison Report Between M85491_PEA_1_P14 (SEQ ID NO:1284) and EPB2_HUMAN (SEQ ID NO:1417):

1. An isolated chimeric polypeptide encoding for M85491_PEA_1_P14 (SEQ ID NO:1284), comprising a first amino acid sequence being at least 90% homologous to MALRRLGAALLLLPLLAAVEETLMDST-TATAELGWMVHPPSGWEEVSGYDENMNTIR TYQVCNVFESSQNNWLRTKFIR-RRGAHRIHVEMKFSVRDCSSIPSVPGSCKETFNLYYY EADFDSATKTFPNWMENPWVKVD-TIAADESFSQVDLGGRVMKINTEVRSFGPVSRSGF YLAFQDYGGCMSLIAVRVFYRKCPRI-IQNGAIFQETLSGAESTSLVAARGSCIANAEEVD VPIKLYCNGDGEWLVPIGRCMCKAGFEAVENGTVCR corresponding to amino acids 1-270 of EPB2_HUMAN (SEQ ID NO:1417), which also corresponds to amino acids 1-270 of M85491_PEA_1_P14 (SEQ ID NO:1284), and a second amino acid sequence being at least 70%, optionally at least 80%, preferably at least 85%, more preferably at least 90% and most preferably at least 95% homologous to a polypeptide having the sequence ERQDLTMLSRLVLNSW-PQMILPPQPPKVLEL (SEQ ID NO:1756) corresponding to amino acids 271-301 of M85491_PEA_1_P14 (SEQ ID NO:1284), wherein said first and second amino acid sequences are contiguous and in a sequential order.

2. An isolated polypeptide encoding for a tail of M85491_PEA_1_P14 (SEQ ID NO:1284) comprising a polypeptide being at least 70%, optionally at least about 80%, preferably at least about 85%, more preferably at least about 90% and most preferably at least about 95% homologous to the sequence ERQDLTMLSRLVLNSWPQMILPPQPPKV-LEL (SEQ ID NO: 1756) in M85491_PEA_1_P14 (SEQ ID NO:1284).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M85491_PEA_1_P14 (SEQ ID NO:1284) is encoded by the following transcript(s): M85491_PEA_1_T20 (SEQ ID NO:4), for which the sequence(s) is/are given at the end of the application. The coding portion of transcript M85491_PEA_1_T20 (SEQ ID NO:4) is shown in bold; this coding portion starts at position 143 and ends at position 1045. The transcript also has the following SNPs as listed in Table 27 (given according to their position on the nucleotide sequence, with the alternative nucleic acid listed; the last column indicates whether the SNP is known or not; the presence of known SNPs in variant protein M85491_PEA_1_P14 (SEQ ID NO:1284) sequence provides support for the deduced sequence of this variant protein according to the present invention).

TABLE 27

Nucleic acid SNPs

| SNP position on nucleotide sequence | Alternative nucleic acid | Previously known SNP? |
|---|---|---|
| 799 | G -> A | Yes |
| 1135 | T -> C | Yes |
| 1160 | T -> C | Yes |
| 1172 | A -> C | Yes |
| 1176 | T -> A | Yes |

As noted above, cluster M85491 features 11 segment(s), which were listed in Table 21 above and for which the sequence(s) are given at the end of the application. These segment(s) are portions of nucleic acid sequence(s) which are described herein separately because they are of particular interest. A description of each segment according to the present invention is now provided.

Segment cluster M85491_PEA_1_node_0 (SEQ ID NO:1028) according to the present invention is supported by 5 libraries. The number of libraries was determined as previously described. This segment can be found in the following transcript(s): M85491_PEA_1_T16 (SEQ ID NO:3) and M85491_PEA_1_T20 (SEQ ID NO:4). Table 28 below describes the starting and ending position of this segment on each transcript.

TABLE 28

Segment location on transcripts

| Transcript name | Segment starting position | Segment ending position |
|---|---|---|
| M85491_PEA_1_T16 (SEQ ID NO: 3) | 1 | 203 |
| M85491_PEA_1_T20 (SEQ ID NO: 4) | 1 | 203 |

Segment cluster M85491_PEA_1_node_13 (SEQ ID NO:1029) according to the present invention is supported by 6 libraries. The number of libraries was determined as previously described. This segment can be found in the following transcript(s): M85491_PEA_1_T20 (SEQ ID NO:4). Table 29 below describes the starting and ending position of this segment on each transcript.

TABLE 29

Segment location on transcripts

| Transcript name | Segment starting position | Segment ending position |
|---|---|---|
| M85491_PEA_1_T20 (SEQ ID NO: 4) | 954 | 1182 |

Segment cluster M85491_PEA_1_node_21 (SEQ ID NO:1030) according to the present invention is supported by 18 libraries. The number of libraries was determined as previously described. This segment can be found in the following transcript(s): M85491_PEA_1_T16 (SEQ ID NO:3). Table 30 below describes the starting and ending position of this segment on each transcript.

TABLE 30

Segment location on transcripts

| Transcript name | Segment starting position | Segment ending position |
|---|---|---|
| M85491_PEA_1_T16 (SEQ ID NO: 3) | 1110 | 1445 |

Segment cluster M85491_PEA_1_node_23 (SEQ ID NO:1031) according to the present invention is supported by 18 libraries. The number of libraries was determined as previously described. This segment can be found in the following transcript(s): M85491_PEA_1_T16 (SEQ ID NO:3). Table 31 below describes the starting and ending position of this segment on each transcript.

TABLE 31

Segment location on transcripts

| Transcript name | Segment starting position | Segment ending position |
|---|---|---|
| M85491_PEA_1_T16 (SEQ ID NO: 3) | 1446 | 1570 |

Segment cluster M85491_PEA_1_node_24 (SEQ ID NO:1032) according to the present invention is supported by 3 libraries. The number of libraries was determined as previously described. This segment can be found in the following transcript(s): M85491_PEA_1_T16 (SEQ ID NO:3). Table 32 below describes the starting and ending position of this segment on each transcript.

TABLE 32

Segment location on transcripts

| Transcript name | Segment starting position | Segment ending position |
|---|---|---|
| M85491_PEA_1_T16 (SEQ ID NO: 3) | 1571 | 2875 |

Segment cluster M85491_PEA_1_node_8 (SEQ ID NO:1033) according to the present invention is supported by 25 libraries. The number of libraries was determined as previously described. This segment can be found in the following transcript(s): M85491_PEA_L_T16 (SEQ ID NO:3) and M85491_PEA_1_T20 (SEQ ID NO:4). Table 33 below describes the starting and ending position of this segment on each transcript.

TABLE 33

Segment location on transcripts

| Transcript name | Segment starting position | Segment ending position |
|---|---|---|
| M85491_PEA_1_T16 (SEQ ID NO: 3) | 269 | 672 |
| M85491_PEA_1_T20 (SEQ ID NO: 4) | 269 | 672 |

Microarray (chip) data is also available for this segment as follows. As described above with regard to the cluster itself, various oligonucleotides were tested for being differentially expressed in various disease conditions, particularly cancer.

The following oligonucleotides were found to hit this segment (in relation to lung cancer), shown in Table 34.

TABLE 34

| Oligonucleotides related to this segment | | |
|---|---|---|
| Oligonucleotide name | Overexpressed in cancers | Chip reference |
| M85491_0_14_0 | lung malignant tumors | LUN |

Segment cluster M85491_PEA_1_node_9 (SEQ ID NO:1034) according to the present invention is supported by 20 libraries. The number of libraries was determined as previously described. This segment can be found in the following transcript(s): M85491_PEA_1_T16 (SEQ ID NO:3) and M85491_PEA_1_T20 (SEQ ID NO:4). Table 35 below describes the starting and ending position of this segment on each transcript.

TABLE 35

| | Segment location on transcripts | |
|---|---|---|
| Transcript name | Segment starting position | Segment ending position |
| M85491_PEA_1_T16 (SEQ ID NO: 3) | 673 | 856 |
| M85491_PEA_1_T20 (SEQ ID NO: 4) | 673 | 856 |

According to an optional embodiment of the present invention, short segments related to the above cluster are also provided. These segments are up to about 120 bp in length, and so are included in a separate description.

Segment cluster M85491_PEA_1_node_10 (SEQ ID NO:1035) according to the present invention is supported by 17 libraries. The number of libraries was determined as previously described. This segment can be found in the following transcript(s): M85491_PEA_1_T16 (SEQ ID NO:3) and M85491_PEA_1_T20 (SEQ ID NO:4). Table 36 below describes the starting and ending position of this segment on each transcript.

TABLE 36

| | Segment location on transcripts | |
|---|---|---|
| Transcript name | Segment starting position | Segment ending position |
| M85491_PEA_1_T16 (SEQ ID NO: 3) | 857 | 953 |
| M85491_PEA_1_T20 (SEQ ID NO: 4) | 857 | 953 |

Segment cluster M85491_PEA_1_node_18 (SEQ ID NO:1036) according to the present invention is supported by 15 libraries. The number of libraries was determined as previously described. This segment can be found in the following transcript(s): M85491_PEA_1_T16 (SEQ ID NO:3). Table 37 below describes the starting and ending position of this segment on each transcript.

TABLE 37

| | Segment location on transcripts | |
|---|---|---|
| Transcript name | Segment starting position | Segment ending position |
| M85491_PEA_1_T16 (SEQ ID NO: 3) | 954 | 1044 |

Segment cluster M85491_PEA_1_node_19 (SEQ ID NO:1037) according to the present invention is supported by 15 libraries. The number of libraries was determined as previously described. This segment can be found in the following transcript(s): M85491_PEA_L_T16 (SEQ ID NO:3). Table 38 below describes the starting and ending position of this segment on each transcript.

TABLE 38

| | Segment location on transcripts | |
|---|---|---|
| Transcript name | Segment starting position | Segment ending position |
| M85491_PEA_1_T16 (SEQ ID NO: 3) | 1045 | 1109 |

Segment cluster M85491_PEA_1_node_6 (SEQ ID NO:1038) according to the present invention is supported by 11 libraries. The number of libraries was determined as previously described. This segment can be found in the following transcript(s): M85491_PEA_1_T16 (SEQ ID NO:3) and M85491_PEA_1_T20 (SEQ ID NO:4). Table 39 below describes the starting and ending position of this segment on each transcript.

TABLE 39

| | Segment location on transcripts | |
|---|---|---|
| Transcript name | Segment starting position | Segment ending position |
| M85491_PEA_1_T16 (SEQ ID NO: 3) | 204 | 268 |
| M85491_PEA_1_T20 (SEQ ID NO: 4) | 204 | 268 |

Variant Protein Alignment to the Previously Known Protein:

Sequence name: /tmp/qfmsU9VtxS/DylcLC9j8v: EPB2_HUMAN (SEQ ID NO:1417)

Sequence documentation:

Alignment of: M85491_PEA_1_P13 (SEQ ID NO:1283) x EPB2_HUMAN (SEQ ID NO:1417)..

Alignment segment 1/1:

| | | | |
|---|---|---|---|
| Quality: | 4726.00 | Escore: | 0 |
| Matching length: | 476 | Total length: | 476 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MALRRLGAALLLLPLLAAVEETLMDSTTATAELGWMVHPPSGWEEVSGYD  50
    ||||||||||||||||||||||||||||||||||||||||||||||||||
  1 MALRRLGAALLLLPLLAAVEETLMDSTTATAELGWMVHPPSGWEEVSGYD  50

51 ENMNTIRTYQVCNVFESSQNNWLRTKFIRRRGAHRIHVEMKFSVRDCSSI 100
    ||||||||||||||||||||||||||||||||||||||||||||||||||
 51 ENMNTIRTYQVCNVFESSQNNWLRTKFIRRRGAHRIHVEMKFSVRDCSSI 100

101 PSVPGSCKETFNLYYYEADFDSATKTFPNWMENPWVKVDTIAADESFSQV 150
    ||||||||||||||||||||||||||||||||||||||||||||||||||
101 PSVPGSCKETFNLYYYEADFDSATKTFPNWMENPWVKVDTIAADESFSQV 150

151 DLGGRVMKINTEVRSFGPVSRSGFYLAFQDYGGCMSLIAVRVFYRKCPRI 200
    |||||||||||||||||||||||||| |||||||||||||||||||||||
151 DLGGRVMKINTEVRSFGPVSRSGFYKAFQDYGGCMSLIAVRVFYRKCPRI 200

201 IQNGAIFQETLSGAESTSLVAARGSCIANAEEVDVPIKLYCNGDGEWLVP 250
    | ||||||||||||||||||||||||||||||||||||||||||||||||
201 IGNGAIFQETLSGAESTSLVAARGSCIANAEEVDVPIKLYCNGDGEWLVP 250

251 IGRCMCKAGFEAVENGTVCRGCPSGTFKANQGDEACTHCPINSRTTSEGA 300
    ||||||||||||||||||||||||||||||||||||||||||||||||||
251 IGRCMCKAGFEAVENGTVCRGCPSGTFKANQGDEACTHCPINSRTTSEGA 300

301 TNCVCRNGYYRADLDPLDMPCTTIPSAPQAVISSVNETSLMLEWTPPRDS 350
    ||||||||||||||||||||||||||||||||||||||||||||||||||
301 TNCVCRNGYYRADLDPLDMPCTTIPSAPQAVISSVNETSLMLEWTPPRDS 350

351 GGREDLVYNIICKSCGSGRGACTRCGDNVQYAPRQLGLTEPRIYISDLLA 400
    |||||||||||||||||||||||||||||| |||||||||||||||||||
351 GGREDLVYNIICKSCGSGRGACTRCGDNVQTAPRQLGLTEPRIYISDLLA 400

401 HTQYTFEIQAVNGVTDQSPFSPQDASVNITTNQAAPSAVSIMHQVSRTVD 450
    |||||||||||||||||||||||| |||||||||||||||||||||||||
401 HTQYTFEIQAVNGVTDQSPFSPQFASVNITTNQAAPSAVSIMHQVSRTVD 450

451 SITLSWSQPDQPNGVILDYELQYYEK                         476
    ||||||||||||||| ||||||||||
451 SITLSWSQPDQPNGBILDYELQYYEK                         476
```

Sequence name: /tmp/rmnzuDbot6/GiHbjeU81R: EPB2_HUMAN (SEQ ID NO:1417)

Sequence documentation:

Alignment of: M85491_PEA__1_P14 (SEQ ID NO:1284) x EPB2_HUMAN (SEQ ID NO:1417) ..

Alignment segment 1/1:

| | | | |
|---|---|---|---|
| Quality: | 2673.00 | Escore: | 0 |
| Matching length: | 270 | Total length: | 270 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MALRRLGAALLLLPLLAAVEETLMDSTTATAELGWMVHPPSGWEEVSGYD  50
    ||||||||||||||||||||||||||||||||||||||||||||||||||
  1 MALRRLGAALLLLPLLAAVEETLMDSTTATAELGWMVHPPSGWEEVSGYD  50

51 ENMNTIRTYQVCNVFESSQNNWLRTKFIRRRGAHRIHVEMKFSVRDCSSI 100
    |||||||||||||| |||||||||||||||||||||||||||||||||||
 51 ENMNTIRTYQVCNCFESSQNNWLRTKFIRRRGAHRIHVEMKFSVRDCSSI 100

101 PSVPGSCKETFNLYYYEADFDSATKTFPNWMENPWVKVDTIAADESFSQV 150
    ||||||||||||||||||||||||||||||||||||||||||||||||||
101 PSVPGSCKETFNLYYYEADFDSATKTFPNWMENPWVKVDTIAADESFSQV 150

151 DLGGRVMKINTEVRSFGPVSRSGFYLAFQDYGGCMSLIAVRVFYRKCPRI 200
    ||||||||||||||||||||||||||||||||||||||||||||||||||
151 DLGGRVMKINTEVRSFGPVSRSGFYLAFQDYGGCMSLIAVRVFYRKCPRI 200
```

```
-continued

201 IQNGAIFQETLSGAESTSLVAARGSCIANAEEVDVPIKLYCNGDGEWLVP 250
    ||||||||||||||| |||||||||||||||||||| |||||||||||||
201 IQNGAIFQETLSFGAESTSLVAARGSCIANAEEVDPIKLYCNGDGEWLVP 250

251 IGRCMCKAGFEAVENGTVCR                               270
    |||||||||||||||| |||
251 IGRCMCKAGFEAVENFTVCR                               270
```

Expression of Ephrin Type-B Receptor 2 Precursor (EC 2.7.1.112) (Tyrosine-Protein Kinase Receptor EPH-3) M85491 Transcripts which are Detectable by Amplicon as Depicted in Sequence Name M85491seg24 (SEQ ID NO:1639) in Normal and Cancerous Lung Tissues Expression of Ephrin type-B receptor 2 precursor (EC 2.7.1.112) (Tyrosine-protein kinase receptor EPH-3) transcripts detectable by or according to seg24, M85491seg24 amplicon (SEQ ID NO:1639) and M85491seg24F (SEQ ID NO:1637) and M85491seg24R (SEQ ID NO: 1638) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2 above, "Tissue samples in testing panel"), to obtain a value of fold up-regulation for each sample relative to median of the normal PM samples.

Figure 10:
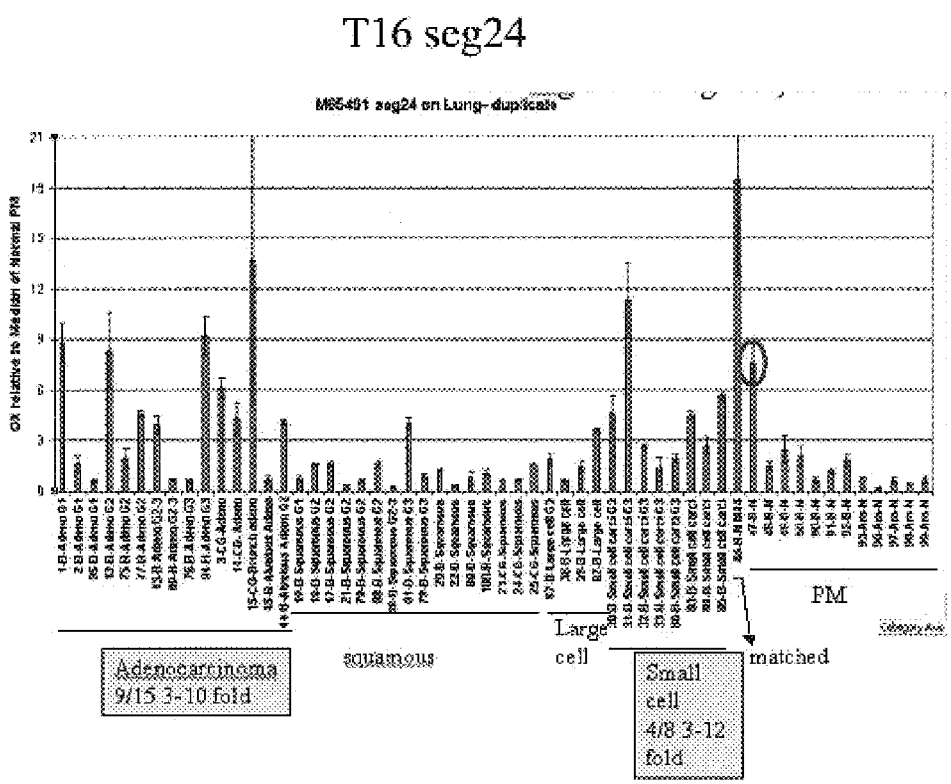
FIG. 10 is a histogram showing over expression of the above-indicated Ephrin type-B receptor 2 precursor M85491 transcripts, which are detectable by amplicon as depicted in sequence name M85491seg24 (SEQ ID NO: 1639), in cancerous lung samples relative to the normal samples.

FIG. 10 below is a histogram showing over expression of the above-indicated Ephrin type-B receptor 2 precursor (EC 2.7.1.112) (Tyrosine-protein kinase receptor EPH-3) transcripts in cancerous lung samples relative to the normal samples. Values represent the average of duplicate experiments. Error bars indicate the minimal and maximal values obtained. The number and percentage of samples that exhibit at least 3 fold over-expression, out of the total number of samples tested, is indicated in the bottom.

As is evident from FIG. 10, the expression of Ephrin type-B receptor 2 precursor (EC 2.7.1.112) (Tyrosine-protein kinase receptor EPH-3) transcripts detectable by the above ampliconin cancer samples was significantly higher than in the non-cancerous samples (Sample Nos. 47-50, 90-93, 96-99 Table 2, "Tissue samples in testing panel".). Notably an over-expression of at least 3 fold was found in 9 out of 15 adenocarcinoma samples and in 4 out of 8 small cell carcinoma samples.

Statistical analysis was applied to verify the significance of these results, as described below.

Threshold of 3 fold overexpression was found to differentiate between cancer and normal samples with P value of 7.42E-03 in adenocarcinoma and 5.69E-02 in small cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: M85491seg24F forward primer (SEQ ID NO:1637); and M85491seg24Rreverse primer (SEQ ID NO:1638).

The present invention also preferably encompasses any amplicon obtained through the use of any suitable primer pair; for example, for the above experiment, the following amplicon was obtained as a non-limiting illustrative example only of a suitable amplicon: M85491seg24 (SEQ ID NO:1639)

```
M85491seg24F- (SEQ ID NO: 1637)
GGCGTCTTTCTCCCTCTGAAC

M85491seg24R- (SEQ ID NO: 1638)
GTCCCATTCTGGGTGCTGTG

M85491seg24- (SEQ ID NO: 1639)
GGCGTCTTTCTCCCTCTGAACCTCAGTTTCCACCTGTGTCGAGTGTGGGTGAGACCC

CTCGCGGGGAGCTATGCAGGTTACGGAGAAAAGGCAGCACAGCACCCAGAATGGG

AC
```

Expression of Ephrin Type-B Receptor 2 Precursor (EC 2.7.1.112) (Tyrosine-protein Kinase Receptor EPH-3) M85491 Transcripts which are Detectable by Amplicon as Depicted in Sequence Name M85491seg24 (SEQ ID NO:1639) in Different Normal Tissues Expression of Ephrin type-B receptor 2 precursor transcripts detectable by or according to M85491 seg24 amplicon (SEQ ID NO:1639) and M85491 seg24F (SEQ ID NO:1637) and M85491 seg24R (SEQ ID NO:1638) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17, Table 2, "Tissue sample on normal panel", above), to obtain a value of relative expression of each sample relative to median of the lung samples.

```
M85491seg24F- (SEQ ID NO: 1637)
GGCGTCTTTCTCCCTCTGAAC

M85491seg24R- (SEQ ID NO: 1638)
GTCCCATTCTGGGTGCTGTG

M85491seg24- (SEQ ID NO: 1639)
GGCGTCTTTCTCCCTCTGAACCTCAGTTTCCACCTGTGTCGAGTGTGGGTGAGACCC

CTCGCGGGGAGCTATGCAGGTTACGGAGAAAAGGCAGCACAGCACCCAGAATGGG

AC
```

Figure 11:
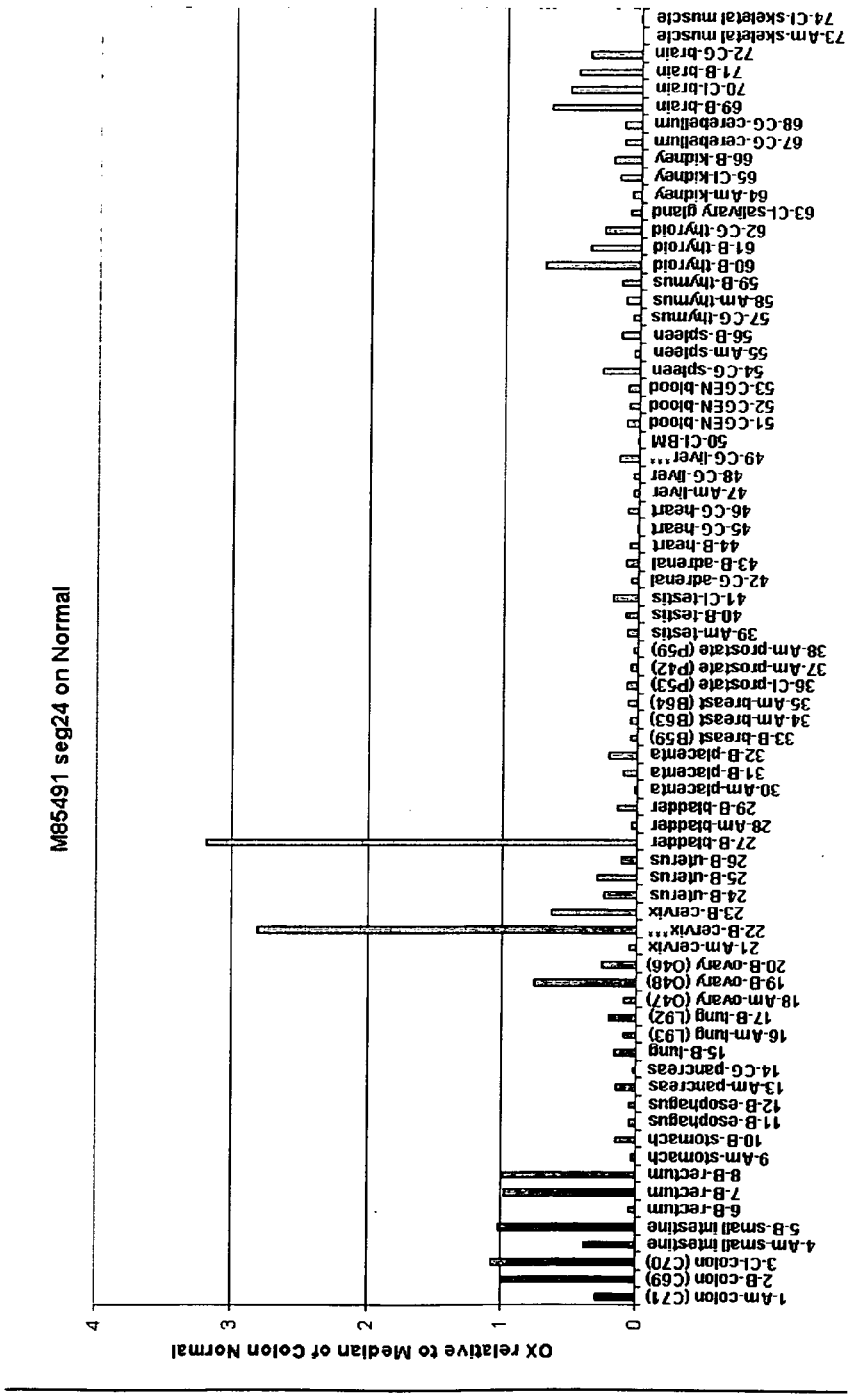
FIG. 11 is a histogram showing the expression of Ephrin type-B receptor 2 precursor (Tyrosine-protein kinase receptor EPH-3) M85491 transcripts which are detectable by amplicon as depicted in sequence name M85491seg24 (SEQ ID NO: 1639) in different normal tissues.

The results are shown in FIG. 11, demonstrating the expression of Ephrin type-B receptor 2 precursor (Tyrosine-protein kinase receptor EPH-3) M85491 transcripts which are detectable by amplicon as depicted in sequence name M85491seg24 (SEQ ID NO:1639) in different normal tissues.

Description for Cluster T39971

Cluster T39971 features 4 transcript(s) and 28 segment(s) of interest, the names for which are given in Tables 40 and 41, respectively, the sequences themselves are given at the end of the application. The selected protein variants are given in table 42.

TABLE 40

Transcripts of interest

| Transcript Name | Sequence ID No. |
| --- | --- |
| T39971_T10 | 5 |
| T39971_T12 | 6 |
| T39971_T16 | 7 |
| T39971_T5 | 8 |

TABLE 41

Segments of interest

| Segment Name | Sequence ID No. |
| --- | --- |
| T39971_node_0 | 168 |
| T39971_node_18 | 169 |
| T39971_node_21 | 170 |
| T39971_node_22 | 171 |
| T39971_node_23 | 172 |
| T39971_node_31 | 173 |
| T39971_node_33 | 174 |
| T39971_node_7 | 175 |
| T39971_node_1 | 176 |
| T39971_node_10 | 177 |
| T39971_node_11 | 178 |
| T39971_node_12 | 179 |

TABLE 41-continued

Segments of interest

| Segment Name | Sequence ID No. |
| --- | --- |
| T39971_node_15 | 180 |
| T39971_node_16 | 181 |
| T39971_node_17 | 182 |
| T39971_node_26 | 183 |
| T39971_node_27 | 184 |
| T39971_node_28 | 185 |

TABLE 41-continued

Segments of interest

| Segment Name | Sequence ID No. |
| --- | --- |
| 139971_node_29 | 186 |
| T39971_node_3 | 187 |
| T39971_node_30 | 188 |
| T39971_node_34 | 189 |
| T39971_node_35 | 190 |
| T39971_node_36 | 191 |
| T39971_node_4 | 192 |
| 139971_node_5 | 193 |
| T39971_node_8 | 194 |
| T39971_node_9 | 195 |

TABLE 42

Proteins of interest

| Protein Name | Sequence ID No. |
| --- | --- |
| T39971_P6 | 1285 |
| T39971_P9 | 1286 |
| T39971_P11 | 1287 |
| T39971_P12 | 1288 |

These sequences are variants of the known protein Vitronectin precursor (SwissProt accession identifier VTNC_HUMAN; known also according to the synonyms Serum spreading factor; S-protein; V75), SEQ ID NO:1418, referred to herein as the previously known protein.

Protein Vitronectin precursor (SEQ ID NO:1418) is known or believed to have the following function(s): Vitronectin is a cell adhesion and spreading factor found in serum and tissues. Vitronectin interacts with glycosaminoglycans and proteoglycans. Is recognized by certain members of the integrin family and serves as a cell-to-substrate adhesion molecule. Inhibitor of the membrane-damaging effect of the terminal cytolytic complement pathway. The sequence for protein Vitronectin precursor is given at the end of the application, as "Vitronectin precursor amino acid sequence". Known polymorphisms for this sequence are as shown in Table 4.

TABLE 43

Amino acid mutations for Known Protein

| SNP position(s) on amino acid sequence | Comment |
|---|---|
| 122 | A -> S. /FTId = VAR__012983. |
| 268 | R -> Q. /FTId = VAR__012984. |
| 400 | T -> M. /FTId = VAR__012985. |
| 50 | C -> N |
| 225 | S -> N |
| 366 | A -> T |

Protein Vitronectin precursor (SEQ ID NO:1418) localization is believed to be Extracellular.

The previously known protein also has the following indication(s) and/or potential therapeutic use(s): Cancer, melanoma. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Alphavbeta3 integrin antagonist; Apoptosis agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: immune response; cell adhesion, which are annotation(s) related to Biological Process; protein binding; heparin binding, which are annotation(s) related to Molecular Function; and extracellular space, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster T39971 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 12 refer to weighted expression of ESTs in each category, as "parts per million" (ratio of the expression of ESTs for a particular cluster to the expression of all ESTs in that category, according to parts per million).

Figure 12:
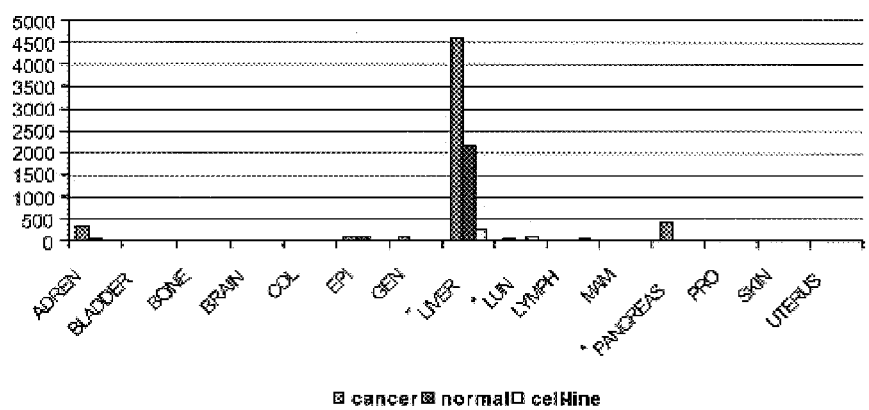
FIG. 12 is a histogram showing Cancer and cell-line vs. normal tissue expression for Cluster T39971, demonstrating overexpression in liver cancer, lung malignant tumors and pancreas carcinoma.

Overall, the following results were obtained as shown with regard to the histograms in FIG. 12 and Table 44. This cluster is overexpressed (at least at a minimum level) in the following pathological conditions: liver cancer, lung malignant tumors and pancreas carcinoma.

TABLE 44

Normal tissue distribution

| Name of Tissue | Number |
|---|---|
| adrenal | 60 |
| bladder | 0 |

TABLE 44-continued

Normal tissue distribution

| Name of Tissue | Number |
|---|---|
| Bone | 0 |
| Brain | 9 |
| Colon | 0 |
| epithelial | 79 |
| general | 29 |
| Liver | 2164 |
| Lung | 0 |
| Lymph nodes | 0 |
| Breast | 0 |
| pancreas | 0 |
| prostate | 0 |
| Skin | 0 |
| Uterus | 0 |

TABLE 45

P values and ratios for expression in cancerous tissue

| Name of Tissue | P1 | P2 | SP1 | R3 | SP2 | R4 |
|---|---|---|---|---|---|---|
| adrenal | 6.9e−01 | 7.4e−01 | 2.0e−02 | 2.3 | 5.3e−02 | 1.8 |
| bladder | 5.4e−01 | 6.0e−01 | 5.6e−01 | 1.8 | 6.8e−01 | 1.5 |
| Bone | 1 | 6.7e−01 | 1 | 1.0 | 7.0e−01 | 1.4 |
| Brain | 8.0e−01 | 8.6e−01 | 3.0e−01 | 1.9 | 5.3e−01 | 1.2 |
| Colon | 4.2e−01 | 4.8e−01 | 7.0e−01 | 1.6 | 7.7e−01 | 1.4 |
| epithelial | 6.6e−01 | 5.7e−01 | 1.0e−01 | 0.8 | 8.7e−01 | 0.6 |
| general | 5.1e−01 | 3.8e−01 | 9.2e−08 | 1.6 | 8.3e−04 | 1.3 |
| Liver | 1 | 6.7e−01 | 2.3e−03 | 0.3 | 1 | 0.2 |
| Lung | 2.4e−01 | 9.1e−02 | 1.7e−01 | 4.3 | 8.1e−03 | 5.0 |
| Lymph nodes | 1 | 5.7e−01 | 1 | 1.0 | 5.8e−01 | 2.3 |
| Breast | 1 | 6.7e−01 | 1 | 1.0 | 8.2e−01 | 1.2 |
| pancreas | 9.5e−02 | 1.8e−01 | 1.5e−11 | 6.5 | 8.2e−09 | 4.6 |
| prostate | 7.3e−01 | 6.0e−01 | 6.7e−01 | 1.5 | 5.6e−01 | 1.7 |
| Skin | 1 | 4.4e−01 | 1 | 1.0 | 6.4e−01 | 1.6 |
| Uterus | 5.0e−01 | 2.6e−01 | 1 | 1.1 | 8.0e−01 | 1.4 |

As noted above, cluster T39971 features 4 transcript(s), which were listed in Table 40 above. These transcript(s) encode for protein(s) which are variant(s) of protein Vitronectin precursor (SEQ ID NO:1418). A description of each variant protein according to the present invention is now provided.

Variant protein T39971_P6 (SEQ ID NO:1285) according to the present invention has an amino acid sequence as given at the end of the application; it is encoded by transcript(s) T39971_T5 (SEQ ID NO:8). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison Report Between T39971_P6 (SEQ ID NO:1285) and VTNC_HUMAN (SEQ ID NO:1418):

1. An isolated chimeric polypeptide encoding for T39971_P6 (SEQ ID NO:1285), comprising a first amino acid sequence being at least 90% homologous to MAPLR-PLLILALLAWVALADQESCKGRCTEGFN-VDKKCQCDELCSYYQSCCTDYTAEC KPQVTRGD-VFTMPEDEYTVYDDGEEKNNATVHEQVGGPSLTSD LQAQSKGNPEQTPV LKPEEEAPAPEVGASKPEGID-SRPETLHPGRPQPPAEEELCSGK-PFDAFTDLKNGSLFAFR GQYCYELDEKAVRPGYPK-LIRDVWGIEGPIDAAFTRINCQGKTYLFKGSQYWRFE DGV LDPDYPRNISDGFDGIPDNVDAALA- LPAHSYSGRERVYFFKG corresponding to amino acids 1-276 of VTNC_HUMAN (SEQ ID NO:1418), which also corresponds to amino acids 1-276 of T39971_P6 (SEQ ID NO:1285), and a second amino acid sequence being at least 70%, optionally at least 80%, preferably at least 85%, more preferably at least 90% and most preferably at least 95% homologous to a polypeptide having the sequence TQGV-VGD (SEQ ID NO:1757) corresponding to amino acids 277-283 of T39971_P6 (SEQ ID NO:1285), wherein said first and second amino acid sequences are contiguous and in a sequential order.

2. An isolated polypeptide encoding for a tail of T39971_P6 (SEQ ID NO:1285), comprising a polypeptide being at least 70%, optionally at least about 80%, preferably at least about 85%, more preferably at least about 90% and most preferably at least about 95% homologous to the sequence TQGVVGD (SEQ ID NO: 1757) in T39971_P6 (SEQ ID NO:1285).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P6 (SEQ ID NO:1285) also has the following non-silent SNPs (Single Nucleotide Polymorphisms) as listed in Table 46, (given according to their position(s) on the amino acid sequence, with the alternative amino acid(s) listed; the last column indicates whether the SNP is known or not; the presence of known SNPs in variant protein T39971_P6 (SEQ ID NO:1285) sequence provides support for the deduced sequence of this variant protein according to the present invention).

TABLE 46

Amino acid mutations

| SNP position(s) on amino acid sequence | Alternative amino acid(s) | Previously known SNP? |
|---|---|---|
| 122 | A -> S | Yes |
| 145 | G -> | No |
| 268 | R -> Q | Yes |
| 280 | V -> A | Yes |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P6 (SEQ ID NO:1285) is encoded by the following transcript(s): T39971_T5 (SEQ ID NO:8), for which the sequence(s) is/are given at the end of the application. The coding portion of transcript T3997_T5 (SEQ ID NO:8) is shown in bold; this coding portion starts at position 756 and ends at position 1604. The transcript also has the following SNPs as listed in Table 47 (given according to their position on the nucleotide sequence, with the alternative nucleic acid listed; the last column indicates whether the SNP is known or not; the presence of known SNPs in variant protein T39971_P6 (SEQ ID NO:1285) sequence provides support for the deduced sequence of this variant protein according to the present invention).

TABLE 47

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1594 | T -> C | Yes |
| 1642 | T -> C | Yes |
| 1770 | C -> T | Yes |
| 529 | G -> T | Yes |
| 1982 | A -> G | No |
| 2007 | G -> | No |
| 2029 | T -> C | No |
| 2094 | T -> C | No |
| 2117 | C -> G | No |
| 2123 | C -> T | Yes |
| 2152 | C -> T | Yes |
| 2182 | G -> T | No |
| 2185 | A -> C | No |
| 2297 | T -> C | Yes |
| 1119 | G -> T | Yes |
| 2411 | G -> | No |
| 2411 | G -> T | No |
| 2487 | T -> C | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P9 (SEQ ID NO:1286) according to the present invention has an amino acid sequence as given at the end of the application; it is encoded by transcript(s) T39971_T10 (SEQ ID NO:5). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison Report Between T39971_P9 (SEQ ID NO:1286) and VTNC_HUMAN (SEQ ID NO:1418):

1. An isolated chimeric polypeptide encoding for T39971_P9 (SEQ ID NO:1286), comprising a first amino acid sequence being at least 90% homologous to MAPLR-PLLILALLAWVALADQESCKGRCTEGFN-VDKKCQCDELCSYYQSCCTDYTAEC KPQVTRGD-VFTMPEDEYTVYDDGEEKNNATVHEQVGGPSLTSD LQAQSKGNPEQTPV LKPEEEAPAPEVGASKPEGID-SRPETLHPGRPQPPAEEELCSGK-PFDAFTDLKNGSLFAFR GQYCYELDEKAVRPGYPK-LIRDVWGIEGPIDAAFTRINCQGKTYLFKGSQYWRF EDGV LDPDYPRNISDGFDGIPDNVDAALA-LPAHSYSGRERVYFFKGKQYWEYQFQHQPSQEE CEGSSLSAVFEHFAMMQRDSWEDIFELLFWGRT corresponding to amino acids 1-325 of VTNC_HUMAN (SEQ ID NO:1418), which also corresponds to amino acids 1-325 of T39971_P9 (SEQ ID NO:1286), and a second amino acid sequence being at least 90% homologous to SGMAPRPSLAKKQRFRHRNRKGYR- SQRGHSRGRNQNSRRPSRATWLSLFSSEESNLGA NNYDDYRMDWLVPATCEPIQSVFFFSGD-KYYRVNLRTRRVDTVDPPYPRSIAQYWLGC PAPGHL corresponding to amino acids 357-478 of VTNC_HUMAN (SEQ ID NO:1418), which also corresponds to amino acids 326-447 of T39971_P9 (SEQ ID NO:1286), wherein said first and second amino acid sequences are contiguous and in a sequential order.

2. An isolated chimeric polypeptide encoding for an edge portion of T39971_P9 (SEQ ID NO:1286), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325−x to 325; and ending at any of amino acid numbers 326+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P9 (SEQ ID NO:1286) also has the following non-silent SNPs (Single Nucleotide Polymorphisms) as listed in Table 48, (given according to their position(s) on the amino acid sequence, with the alternative amino acid(s) listed; the last column indicates whether the SNP is known or not; the presence of known SNPs in variant protein T39971_P9 (SEQ ID NO:1286) sequence provides support for the deduced sequence of this variant protein according to the present invention).

TABLE 48

Amino acid mutations

| SNP position(s) on amino acid sequence | Alternative amino acid(s) | Previously known SNP? |
|---|---|---|
| 122 | A -> S | Yes |
| 145 | G -> | No |
| 268 | R -> Q | Yes |
| 328 | M -> T | No |
| 350 | S -> P | No |
| 369 | T -> M | Yes |
| 379 | S -> I | No |
| 380 | N -> T | No |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P9 (SEQ ID NO:1286) is encoded by the following transcript(s): T39971_T10 (SEQ ID NO:5), for which the sequence(s) is/are given at the end of the application. The coding portion of transcript T39971_T10 (SEQ ID NO:5) is shown in bold; this coding portion starts at position 756 and ends at position 2096. The transcript also has the following SNPs as listed in Table 49 (given according to their position on the nucleotide sequence, with the alternative nucleic acid listed; the last column indicates whether the SNP is known or not; the presence of known SNPs in variant protein T39971_P9 (SEQ ID NO:1286) sequence provides support for the deduced sequence of this variant protein according to the present invention).

TABLE 49

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1738 | T -> C | No |
| 1803 | T -> C | No |
| 1826 | C -> G | No |
| 529 | G -> T | Yes |
| 1832 | C -> T | Yes |
| 1861 | C -> T | Yes |
| 1891 | G -> T | No |
| 1894 | A -> C | No |
| 2006 | T -> C | Yes |
| 2120 | G -> | No |
| 2120 | G -> T | No |
| 2196 | T -> C | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P11 (SEQ ID NO:1287) according to the present invention has an amino acid sequence as given at the end of the application; it is encoded by transcript(s) T39971_T12 (SEQ ID NO:6). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison Report Between T39971_P11 (SEQ ID NO:1287) and VTNC_HUMAN (SEQ ID NO:1418):

1. An isolated chimeric polypeptide encoding for T39971_P11 (SEQ ID NO:1287), comprising a first amino acid sequence being at least 90% homologous to MAPLRPLLILALLAWVALADQESCKGRCTEGFN-VDKKCQCDELCSYYQSCCTDYTAEC KPQVTRGD-VFTMPEDEYTVYDDGEEKNNATVHEQVGGPSLTSD LQAQSKGNPEQTPV LKPEEEAPAPEVGASKPEGID-SRPETLHPGRPQPPAEEELCSGK-PFDAFTDLKNGSLFAFR GQYCYELDEKAVRPGYPK-LIRDVWGIEGPIDAAFTRINCQGKTYLFKGSQYWRFE DGV LDPDYPRNISDGFDGIPDNVDAALA-LPAHSYSGRERVYFFKGKQYWEYQFQHQPSQEE CEGSSLSAVFEHFAMMQRDSWEDIFELLFWGRTS corresponding to amino acids 1-326 of VTNC_HUMAN (SEQ ID NO:1418), which also corresponds to amino acids 1-326 of T39971_P11 (SEQ ID NO:1287), and a second amino acid sequence being at least 90% homologous to DKYYRVNLR-TRRVDTVDPPYPRSIAQYWLGCPAPGHL corresponding to amino acids 442-478 of VTNC_HUMAN (SEQ ID NO:1418), which also corresponds to amino acids 327-363 of T399711_P 11 (SEQ ID NO:1287), wherein said first and second amino acid sequences are contiguous and in a sequential order.

2. An isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326–x to 326; and ending at any of amino acid numbers 327+((n−2)−x), in which x varies from 0 to n−2.

Comparison Report Between T39971_P11 (SEQ ID NO:1287) and Q9BSH7 (SEQ ID NO:1696):

1. An isolated chimeric polypeptide encoding for T39971_P11 (SEQ ID NO:1287), comprising a first amino acid sequence being at least 90% homologous to MAPLRPLLILALLAWVALADQESCKGRCTEGFNVDKKCQCDELCSYYQSCCTDYTAEC KPQVTRGDVFTMPEDEYTVYDDGEEKNNATVHEQVGGPSLTSD LQAQSKGNPEQTPV LKPEEEAPAPEVGASKPEGIDSRPETLHPGRPQPPAEEELCSGK-PFDAFTDLKNGSLFAFR GQYCYELDEKAVRPGYPKLIRDVWGIEGPIDAAFTRINCQGKTYLFKGSQYWRF EDGV LDPDYPRNISDGFDGIPDNVDAALALPAHSYSGRERVYFFKGKQYWEYQFQHQPSQEE CEGSSLSAVFEHFAMMQRDSWEDIFELLFWGRTS corresponding to amino acids 1-326 of Q9BSH7, which also corresponds to amino acids 1-326 of T39971_P11 (SEQ ID NO:1287), and a second amino acid sequence being at least 90% homologous to DKYYRVNLRTRRVDTVDPPYPRSIAQYWLGCPAPGHL corresponding to amino acids 442-478 of Q9BSH7, which also corresponds to amino acids 327-363 of T39971_P11 (SEQ ID NO:1287), wherein said first and second amino acid sequences are contiguous and in a sequential order.

2. An isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326–x to 326; and ending at any of amino acid numbers 327+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P11 (SEQ ID NO:1287) also has the following non-silent SNPs (Single Nucleotide Polymorphisms) as listed in Table 50, (given according to their position(s) on the amino acid sequence, with the alternative amino acid(s) listed; the last column indicates whether the SNP is known or not; the presence of known SNPs in variant protein T39971_P11 (SEQ ID NO:1287) sequence provides support for the deduced sequence of this variant protein according to the present invention).

TABLE 50

Amino acid mutations

| SNP position(s) on amino acid sequence | Alternative amino acid(s) | Previously known SNP? |
| --- | --- | --- |
| 122 | A -> S | Yes |
| 145 | G -> | No |
| 268 | R -> Q | Yes |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P11 (SEQ ID NO:1287) is encoded by the following transcript(s): T39971_T12 (SEQ ID NO:6), for which the sequence(s) is/are given at the end of the application. The coding portion of transcript T39971_T12 (SEQ ID NO:6) is shown in bold; this coding portion starts at position 756 and ends at position 1844. The transcript also has the following SNPs as listed in Table 51 (given according to their position on the nucleotide sequence, with the alternative nucleic acid listed; the last column indicates whether the SNP is known or not; the presence of known SNPs in variant protein T39971_P11 (SEQ ID NO:1287) sequence provides support for the deduced sequence of this variant protein according to the present invention).

TABLE 51

Nucleic acid SNPs

| SNP position on nucleotide sequence | Alternative nucleic acid | Previously known SNP? |
| --- | --- | --- |
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1754 | T -> C | Yes |
| 1868 | G -> | No |
| 1868 | G -> T | No |
| 529 | G -> T | Yes |
| 1944 | T -> C | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P12 (SEQ ID NO:1288) according to the present invention has an amino acid sequence as given at the end of the application; it is encoded by transcript(s) T39971_T16 (SEQ ID NO:7). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison Report Between T39971_P12 (SEQ ID NO:1288) and VTNC_HUMAN (SEQ ID NO:1418):

1. An isolated chimeric polypeptide encoding for T39971_P12 (SEQ ID NO:1288), comprising a first amino acid sequence being at least 90% homologous to MAPLRPLLILALLAWVALADQESCKGRCTEGFNVDKKCQCDELCSYYQSCCTDYTAEC KPQVTRGDVFTMPEDEYTVYDDGEEKNNATVHEQVGGPSLTSD LQAQSKGNPEQTPV LKPEEEAPAPEVGASKPEGIDSRPETLHPGRPQPPAEEELCSGK-PFDAFTDLKNGSLFAFR GQYCYELDEKAVRPGYPKLIRDVWGIEGPIDAAFTRINCQGKTYLFK corresponding to amino acids 1-223 of VTNC_HUMAN (SEQ ID NO:1418), which also corresponds to amino acids 1-223 of T39971_P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1758) corresponding to amino acids 224-238 of T39971_P12 (SEQ ID NO:1288), wherein said first and second amino acid sequences are contiguous and in a sequential order.

2. An isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1758) in T39971_P12 (SEQ ID NO:1288).

Comparison Report Between T39971_P12 (SEQ ID NO:1288) and Q9BSH7:

1. An isolated chimeric polypeptide encoding for T39971_P12 (SEQ ID NO:1288), comprising a first amino acid sequence being at least 90% homologous to MAPLRPLLILALLAWVALADQESCKGRCTEGFNVDKKCQCDELCSYYQSCCTDYTAEC KPQVTRGDVFTMPEDEYTVYDDGEEKNNATVHEQVGGPSLTSD LQAQSKGNPEQTPV LKPEEEAPAPEVGASKPEGIDSRPETLHPGRPQPPAEEELCSGK-PFDAFTDLKNGSLFAFR GQYCYELDEKAVRPGYPKLIRDVWGIEGPIDAAFTRINCQGKTYLFK corresponding to amino acids 1-223 of Q9BSH7, which also corresponds to amino acids 1-223 of T39971_P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1758) corresponding to amino acids 224-238 of T39971_P12 (SEQ ID NO:1288), wherein said first and second amino acid sequences are contiguous and in a sequential order.

2. An isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1758) in T39971_P12 (SEQ ID NO:1288).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P12 (SEQ ID NO:1288) also has the following non-silent SNPs (Single Nucleotide Polymorphisms) as listed in Table 52, (given according to their position(s) on the amino acid sequence, with the alternative amino acid(s) listed; the last column indicates whether the SNP is known or not; the presence of known SNPs in variant protein T39971_P12 (SEQ ID NO:1288) sequence provides support for the deduced sequence of this variant protein according to the present invention).

TABLE 52

Amino acid mutations

| SNP position(s) on amino acid sequence | Alternative amino acid(s) | Previously known SNP? |
|---|---|---|
| 122 | A -> S | Yes |
| 145 | G -> | No |
| 180 | C -> | No |
| 180 | C -> W | No |
| 192 | Y -> | No |
| 209 | A -> | No |
| 211 | T -> | No |

Variant protein T39971_P12 (SEQ ID NO:1288) is encoded by the following transcript(s): T39971_T16 (SEQ ID NO:7), for which the sequence(s) is/are given at the end of the application. The coding portion of transcript T39971_T16 (SEQ ID NO:7) is shown in bold; this coding portion starts at position 756 and ends at position 1469. The transcript also has the following SNPs as listed in Table 53 (given according to their position on the nucleotide sequence, with the alternative nucleic acid listed; the last column indicates whether the SNP is known or not; the presence of known SNPs in variant protein T39971_P12 (SEQ ID NO:1288) sequence provides support for the deduced sequence of this variant protein according to the present invention).

TABLE 53

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 529 | G -> T | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

As noted above, cluster T39971 features 28 segment(s), which were listed in Table 41 above and for which the sequence(s) are given at the end of the application. These segment(s) are portions of nucleic acid sequence(s) which are described herein separately because they are of particular interest. A description of each segment according to the present invention is now provided.

Segment cluster T39971_node_0 (SEQ ID NO:1039) according to the present invention is supported by 76 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 54 below describes the starting and ending position of this segment on each transcript.

TABLE 54

Segment location on transcripts

| Transcript name | Segment starting position | Segment ending position |
|---|---|---|
| T39971_T10 (SEQ ID NO: 5) | 1 | 810 |
| T39971_T12 (SEQ ID NO: 6) | 1 | 810 |
| T39971_T16 (SEQ ID NO: 7) | 1 | 810 |
| T39971_T5 (SEQ ID NO: 8) | 1 | 810 |

Segment cluster T39971_node_18 (SEQ ID NO:1040) according to the present invention is supported by 1 libraries. The number of libraries was determined as previously described. This segment can be found in the following transcript(s): T39971_T16 (SEQ ID NO:7). Table 55 below describes the starting and ending position of this segment on each transcript.

TABLE 55

Segment location on transcripts

| Transcript name | Segment starting position | Segment ending position |
|---|---|---|
| T39971_T16 (SEQ ID NO: 7) | 1425 | 1592 |

Segment cluster T39971_node_21 (SEQ ID NO:1041) according to the present invention is supported by 99 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 56 below describes the starting and ending position of this segment on each transcript.

TABLE 56

Segment location on transcripts

| Transcript name | Segment starting position | Segment ending position |
|---|---|---|
| T39971_T10 (SEQ ID NO: 5) | 1425 | 1581 |
| T39971_T12 (SEQ ID NO: 6) | 1425 | 1581 |
| T39971_T5 (SEQ ID NO: 8) | 1425 | 1581 |

Segment cluster T39971_node_22 (SEQ ID NO:1042) according to the present invention is supported by 7 libraries. The number of libraries was determined as previously described. This segment can be found in the following transcript(s): T39971_T5 (SEQ ID NO:8). Table 57 below describes the starting and ending position of this segment on each transcript.

TABLE 57

Segment location on transcripts

| Transcript name | Segment starting position | Segment ending position |
|---|---|---|
| T39971_T5 (SEQ ID NO: 8) | 1582 | 1779 |

Segment cluster T39971_node_23 (SEQ ID NO:1043) according to the present invention is supported by 101 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 58 below describes the starting and ending position of this segment on each transcript.

TABLE 58

Segment location on transcripts

| Transcript name | Segment starting position | Segment ending position |
|---|---|---|
| T39971_T10 (SEQ ID NO: 5) | 1582 | 1734 |
| T39971_T12 (SEQ ID NO: 6) | 1582 | 1734 |
| T39971_T5 (SEQ ID NO: 8) | 1780 | 1932 |

Segment cluster T39971_node_31 (SEQ ID NO:1044) according to the present invention is supported by 94 libraries. The number of libraries was determined as previously described. This segment can be found in the following transcript(s): T39971_T10 (SEQ ID NO:5) and T39971_T5 (SEQ ID NO:8). Table 59 below describes the starting and ending position of this segment on each transcript.

TABLE 59

Segment location on transcripts

| Transcript name | Segment starting position | Segment ending position |
|---|---|---|
| T39971_T10 (SEQ ID NO: 5) | 1847 | 1986 |
| T39971_T5 (SEQ ID NO: 8) | 2138 | 2277 |

Segment cluster T39971_node_33 (SEQ ID NO:1045) according to the present invention is supported by 77 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 60 below describes the starting and ending position of this segment on each transcript.

TABLE 60

Segment location on transcripts

| Transcript name | Segment starting position | Segment ending position |
|---|---|---|
| T39971_T10 (SEQ ID NO: 5) | 1987 | 2113 |
| T39971_T12 (SEQ ID NO: 6) | 1735 | 1861 |
| T39971_T5 (SEQ ID NO: 8) | 2278 | 2404 |

Segment cluster T39971_node_7 (SEQ ID NO:1046) according to the present invention is supported by 87 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 61 below describes the starting and ending position of this segment on each transcript.

TABLE 61

Segment location on transcripts

| Transcript name | Segment starting position | Segment ending position |
|---|---|---|
| T39971_T10 (SEQ ID NO: 5) | 940 | 1162 |
| T39971_T12 (SEQ ID NO: 6) | 940 | 1162 |
| T39971_T16 (SEQ ID NO: 7) | 940 | 1162 |
| T39971_T5 (SEQ ID NO: 8) | 940 | 1162 |

According to an optional embodiment of the present invention, short segments related to the above cluster are also provided. These segments are up to about 120 bp in length, and so are included in a separate description.

Segment cluster T39971_node_1 (SEQ ID NO:1047) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 62 below describes the starting and ending position of this segment on each transcript.

TABLE 62

Segment location on transcripts

| Transcript name | Segment starting position | Segment ending position |
|---|---|---|
| T39971_T10 (SEQ ID NO: 5) | 811 | 819 |
| T39971_T12 (SEQ ID NO: 6) | 811 | 819 |
| T39971_T16 (SEQ ID NO: 7) | 811 | 819 |
| T39971_T5 (SEQ ID NO: 8) | 811 | 819 |

Segment cluster T39971_node_10 (SEQ ID NO:1048) according to the present invention is supported by 77 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 63 below describes the starting and ending position of this segment on each transcript.

TABLE 63

Segment location on transcripts

| Transcript name | Segment starting position | Segment ending position |
|---|---|---|
| T39971_T10 (SEQ ID NO: 5) | 1189 | 1232 |
| T39971_T12 (SEQ ID NO: 6) | 1189 | 1232 |
| T39971_T16 (SEQ ID NO: 7) | 1189 | 1232 |
| T39971_T5 (SEQ ID NO: 8) | 1189 | 1232 |

Segment cluster T39971_node_11 (SEQ ID NO:1049) according to the present invention is supported by 79 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 64 below describes the starting and ending position of this segment on each transcript.

TABLE 64

Segment location on transcripts

| Transcript name | Segment starting position | Segment ending position |
|---|---|---|
| T39971_T10 (SEQ ID NO: 5) | 1233 | 1270 |
| T39971_T12 (SEQ ID NO: 6) | 1233 | 1270 |
| T39971_T16 (SEQ ID NO: 7) | 1233 | 1270 |
| T39971_T5 (SEQ ID NO: 8) | 1233 | 1270 |

Segment cluster T39971_node_12 (SEQ ID NO:1050) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 65 below describes the starting and ending position of this segment on each transcript.

TABLE 65

Segment location on transcripts

| Transcript name | Segment starting position | Segment ending position |
|---|---|---|
| T39971_T10 (SEQ ID NO: 5) | 1271 | 1284 |
| T39971_T12 (SEQ ID NO: 6) | 1271 | 1284 |
| T39971_T16 (SEQ ID NO: 7) | 1271 | 1284 |
| T39971_T5 (SEQ ID NO: 8) | 1271 | 1284 |

Segment cluster T39971_node_15 (SEQ ID NO:1051) according to the present invention is supported by 79 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 66 below describes the starting and ending position of this segment on each transcript.

TABLE 66

Segment location on transcripts

| Transcript name | Segment starting position | Segment ending position |
|---|---|---|
| T39971_T10 (SEQ ID NO: 5) | 1285 | 1316 |
| T39971_T12 (SEQ ID NO: 6) | 1285 | 1316 |
| T39971_T16 (SEQ ID NO: 7) | 1285 | 1316 |
| T39971_T5 (SEQ ID NO: 8) | 1285 | 1316 |

Segment cluster T39971_node_16 (SEQ ID NO:1052) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 67 below describes the starting and ending position of this segment on each transcript.

TABLE 67

Segment location on transcripts

| Transcript name | Segment starting position | Segment ending position |
|---|---|---|
| T39971_T10 (SEQ ID NO: 5) | 1317 | 1340 |
| T39971_T12 (SEQ ID NO: 6) | 1317 | 1340 |
| T39971_T16 (SEQ ID NO: 7) | 1317 | 1340 |
| T39971_T5 (SEQ ID NO: 8) | 1317 | 1340 |

Segment cluster T39971_node_17 (SEQ ID NO:1053) according to the present invention is supported by 86 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 68 below describes the starting and ending position of this segment on each transcript.

TABLE 68

Segment location on transcripts

| Transcript name | Segment starting position | Segment ending position |
| --- | --- | --- |
| T39971_T10 (SEQ ID NO: 5) | 1341 | 1424 |
| T39971_T12 (SEQ ID NO: 6) | 1341 | 1424 |
| T39971_T16 (SEQ ID NO: 7) | 1341 | 1424 |
| T39971_T5 (SEQ ID NO: 8) | 1341 | 1424 |

Segment cluster T39971_node_26 (SEQ ID NO:1054) according to the present invention is supported by 85 libraries. The number of libraries was determined as previously described. This segment can be found in the following transcript(s): T39971_T5 (SEQ ID NO:8). Table 69 below describes the starting and ending position of this segment on each transcript.

TABLE 69

Segment location on transcripts

| Transcript name | Segment starting position | Segment ending position |
| --- | --- | --- |
| T39971_T5 (SEQ ID NO: 8) | 1933 | 1974 |

Segment cluster T39971_node_27 (SEQ ID NO:1055) according to the present invention is supported by 90 libraries. The number of libraries was determined as previously described. This segment can be found in the following transcript(s): T39971_T5 (SEQ ID NO:8). Table 70 below describes the starting and ending position of this segment on each transcript.

TABLE 70

Segment location on transcripts

| Transcript name | Segment starting position | Segment ending position |
| --- | --- | --- |
| T39971_T5 (SEQ ID NO: 8) | 1975 | 2025 |

Segment cluster T39971_node_28 (SEQ ID NO:1056) according to the present invention can be found in the following transcript(s): T39971_T10 (SEQ ID NO:5) and T39971_T5 (SEQ ID NO:8). Table 71 below describes the starting and ending position of this segment on each transcript.

TABLE 71

Segment location on transcripts

| Transcript name | Segment starting position | Segment ending position |
| --- | --- | --- |
| T39971_T10 (SEQ ID NO: 5) | 1735 | 1743 |
| T39971_T5 (SEQ ID NO: 8) | 2026 | 2034 |

Segment cluster T39971_node_29 (SEQ ID NO:1057) according to the present invention is supported by 99 libraries. The number of libraries was determined as previously described. This segment can be found in the following transcript(s): T39971_T10 (SEQ ID NO:5) and T39971_T5 (SEQ ID NO:8). Table 72 below describes the starting and ending position of this segment on each transcript.

TABLE 72

Segment location on transcripts

| Transcript name | Segment starting position | Segment ending position |
| --- | --- | --- |
| T39971_T10 (SEQ ID NO: 5) | 1744 | 1838 |
| T39971_T5 (SEQ ID NO: 8) | 2035 | 2129 |

Segment cluster T39971_node_3 (SEQ ID NO:1058) according to the present invention is supported by 78 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 73 below describes the starting and ending position of this segment on each transcript.

TABLE 73

Segment location on transcripts

| Transcript name | Segment starting position | Segment ending position |
| --- | --- | --- |
| T39971_T10 (SEQ ID NO: 5) | 820 | 861 |
| T39971_T12 (SEQ ID NO: 6) | 820 | 861 |
| T39971_T16 (SEQ ID NO: 7) | 820 | 861 |
| T39971_T5 (SEQ ID NO: 8) | 820 | 861 |

Segment cluster T39971_node_30 (SEQ ID NO:1059) according to the present invention can be found in the following transcript(s): T39971_T10 (SEQ ID NO:5) and T39971_T5 (SEQ ID NO:8). Table 74 below describes the starting and ending position of this segment on each transcript.

TABLE 74

Segment location on transcripts

| Transcript name | Segment starting position | Segment ending position |
| --- | --- | --- |
| T39971_T10 (SEQ ID NO: 5) | 1839 | 1846 |
| T39971_T5 (SEQ ID NO: 8) | 2130 | 2137 |

Segment cluster T39971_node_34 (SEQ ID NO:1060) according to the present invention can be found in the following transcript(s): T39971_T10 (SEQ ID NO:5), T39971_T12 (SEQ ID NO:6) and T39971_T5 (SEQ ID NO:8). Table 75 below describes the starting and ending position of this segment on each transcript.

TABLE 75

Segment location on transcripts

| Transcript name | Segment starting position | Segment ending position |
|---|---|---|
| T39971_T10 (SEQ ID NO: 5) | 2114 | 2120 |
| T39971_T12 (SEQ ID NO: 6) | 1862 | 1868 |
| T39971_T5 (SEQ ID NO: 8) | 2405 | 2411 |

Segment cluster T39971_node_35 (SEQ ID NO:1061) according to the present invention can be found in the following transcript(s): T39971_T10 (SEQ ID NO:5), T39971_T12 (SEQ ID NO:6) and T39971_T5 (SEQ ID NO:8). Table 76 below describes the starting and ending position of this segment on each transcript.

TABLE 76

Segment location on transcripts

| Transcript name | Segment starting position | Segment ending position |
|---|---|---|
| T39971_T10 (SEQ ID NO: 5) | 2121 | 2137 |
| T39971_T12 (SEQ ID NO: 6) | 1869 | 1885 |
| T39971_T5 (SEQ ID NO: 8) | 2412 | 2428 |

Segment cluster T39971_node_36 (SEQ ID NO:1062) according to the present invention is supported by 51 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 77 below describes the starting and ending position of this segment on each transcript.

TABLE 77

Segment location on transcripts

| Transcript name | Segment starting position | Segment ending position |
|---|---|---|
| T39971_T10 (SEQ ID NO: 5) | 2138 | 2199 |
| T39971_T12 (SEQ ID NO: 6) | 1886 | 1947 |
| T39971_T5 (SEQ ID NO: 8) | 2429 | 2490 |

Segment cluster T39971_node_4 (SEQ ID NO:1063) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 78 below describes the starting and ending position of this segment on each transcript.

TABLE 78

Segment location on transcripts

| Transcript name | Segment starting position | Segment ending position |
|---|---|---|
| T39971_T10 (SEQ ID NO: 5) | 862 | 881 |
| T39971_T12 (SEQ ID NO: 6) | 862 | 881 |
| T39971_T16 (SEQ ID NO: 7) | 862 | 881 |
| T39971_T5 (SEQ ID NO: 8) | 862 | 881 |

Segment cluster T39971_node_5 (SEQ ID NO:1064) according to the present invention is supported by 80 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 79 below describes the starting and ending position of this segment on each transcript.

TABLE 79

Segment location on transcripts

| Transcript name | Segment starting position | Segment ending position |
|---|---|---|
| T39971_T10 (SEQ ID NO: 5) | 882 | 939 |
| T39971_T12 (SEQ ID NO: 6) | 882 | 939 |
| T39971_T16 (SEQ ID NO: 7) | 882 | 939 |
| T39971_T5 (SEQ ID NO: 8) | 882 | 939 |

Segment cluster T39971_node_8 (SEQ ID NO:1065) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 80 below describes the starting and ending position of this segment on each transcript.

TABLE 80

Segment location on transcripts

| Transcript name | Segment starting position | Segment ending position |
|---|---|---|
| T39971_T10 (SEQ ID NO: 5) | 1163 | 1168 |
| T39971_T12 (SEQ ID NO: 6) | 1163 | 1168 |
| T39971_T16 (SEQ ID NO: 7) | 1163 | 1168 |
| T39971_T5 (SEQ ID NO: 8) | 1163 | 1168 |

Segment cluster T39971_node_9 (SEQ ID NO:1066) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 81 below describes the starting and ending position of this segment on each transcript.

TABLE 81

Segment location on transcripts

| Transcript name | Segment starting position | Segment ending position |
|---|---|---|
| T39971_T10 (SEQ ID NO: 5) | 1169 | 1188 |
| T39971_T12 (SEQ ID NO: 6) | 1169 | 1188 |
| T39971_T16 (SEQ ID NO: 7) | 1169 | 1188 |
| T39971_T5 (SEQ ID NO: 8) | 1169 | 1188 |

Variant Protein Alignment to the Previously Known Protein:
Sequence name: /tmp/xkraCL2OcZ/43L7YcPH7x:VTNC_HUMAN (SEQ ID NO:1418)
Sequence documentation:
Alignment of: T39971_P6 (SEQ ID NO:1285) x VTNC_HUMAN (SEQ ID NO:1418) ..
Alignment segment 1/1:

| | | | |
|---|---|---|---|
| Quality: | 2774.00 | Escore: | 0 |
| Matching length: | 278 | Total length: | 278 |
| Matching Percent Similarity: | 99.64 | Matching Percent Identity: | 99.64 |
| Total Percent Similarity: | 99.64 | Total Percent Identity: | 99.64 |
| Gaps: | 0 | | |

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFKGSQYWRFEDGVLDPDYPRNISDGFDGI 250
    ||||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGTQ                       278
    ||||||||||||||||||||||||||:|
251 PDNVDAALALPAHSYSGRERVYFFKGKQ                       278
```

Sequence name: /tmp/X4DeeuSlB4/yMubSR5FPs:VTNC_HUMAN (SEQ ID NO:1418)
Sequence documentation:
Alignment of: T39971_P9 (SEQ ID NO:1286) x VTNC_HUMAN (SEQ ID NO:1418)..
Alignment segment 1/1:

| | | | |
|---|---|---|---|
| Quality: | 4430.00 | Escore: | 0 |
| Matching length: | 447 | Total length: | 478 |
| Matching Percent Similarity: | 100.00 | Matching Percent Identity: | 100.00 |
| Total Percent Similarity: | 93.51 | Total Percent Identity: | 93.51 |
| Gaps: | 1 | | |

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    |||||||||||||||||||||||||||||||||||||||||:||||||||
151 AEEELCSGKPFDAFTDLKNGSLFAFRGQYCYELDEKAVRPGTPKLIRDVW 200

201 GIEGPIDAAFTRINCQGKTYLFKGSQYWRFEDGVLDPDYPRNISDGFDGI 250
    ||||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGKQYWEYQFQHQPSQEECEGSSLSA 300
    ||||||||||||||||||||||||||||||||||||||||||||||||||
251 PDNVDAALALPAHSYSGRERVYFFKGKQYWEYQFQHQPSQEECEGSSLSA 300

301 VFEHFAMMQRDSWEDIFELLFWGRT........................ 325
    ||||||||||||||||||||||||
301 VFEHFAMMQRDSWEDIFELLFWGRTSAGTRQPQFISRDWHGVPGQVDAAM 350

326 ......SGMAPRPSLAKKQRFRFRNRKGYRSQRGHSRGRNQNSRRPSRAT 369
          ||||||||||||||||:|:|||||||||:|||||||||||||||
351 AGRITISGMAPRPSLAKKQRFRHRNRKGYRSQRGRNQNSRRPSRAT 400
```

-continued

```
370 WLSLFSSEESNLGANNYDDYRMDWLVPATCEPIQSVFFFSGDKYYRVNLR 419
    ||||||||||||||||||||||||||||||||||||||||||||||||||
401 WLSLFSSEESNLGANNYDDYRMDWLVPATCEPIQSVFFFSGDKYYRVNLR 450

420 TRRVDTVDPPYPRSIAQYWLGCPAPGHL                      447
    ||||||||||||||||||||||||||||
451 TRRVDTVDPPYPRSIAQYWLGCPAPGHL                      478
```

Sequence name: /tmp/jvp1VtnxNy/wxNSeFVZZw:VTNC_HUMAN (SEQ ID NO:1418)

Sequence documentation:

Alignment of: T39971_P11 (SEQ ID NO:1287) x VTNC_HUMAN (SEQ ID NO:1418) ..

Alignment segment 1/1:

| | | | |
|---|---|---|---|
| Quality: | 3576.00 | Escore: | 0 |
| Matching length: | 363 | Total length: | 478 |
| Matching Percent Similarity: | 100.00 | Matching Percent Identity: | 100.00 |
| Total Percent Similarity: | 75.94 | Total Percent Identity: | 75.94 |
| Gaps: | 1 | | |

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFKGSQYWRFEDGVLDPDYPRNISDGFDGI 250
    ||||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGKQYWEYQFQHQPSQEECEGSSLSA 300
    ||||||||||||||||||||||||||||||||||||||||||||||||||
251 PDNVDAALALPAHSYSGRERVYFFKGKQYWEYQFQHQPSQEECEGSSLSA 300

301 VFEHFAMMQRDSWEDIFELLFWGRTS........................ 326
    |||||||||||||||||||||||||
301 VFEHFAMMQRDSWEDIFELLFWGRTSAGTRQPQFISRDWHGVPGQVDAAM 350

326 .................................................. 326

351 AGRIYISGMAPRPSLAKKQRFRHRNRKGYRSQRGHSRGRNQNSRRPSRAT 400

327 ..........................................DKYYRVNLR 335
                                              |||||||||
401 WLSLFSSEESNLGANNYDDYRMDWLVPATCEPIQSVFFFSGDKYYRVNLR 450

336 TRRVDTVDPPYPRSIAQYWLGCPAPGHL                      363
    ||||||||||||||||||||||||||||
451 TRRVDTVDPPYPRSIAQYWLGCPAPGHL                      478
```

Sequence name: /tmp/jvp1VtnxNy/wxNSeFVZZw: Q9BSH7

Sequence documentation:

Alignment of: T39971_P11 (SEQ ID NO:1287) x Q9BSH7 ..

Alignment segment 1/1:

| | |
|---|---|
| Quality: | 3576.00 |
| Matching length: | 363 |

| | |
|---|---|
| Escore: | 0 |
| Total length: | 478 |

| | | | |
|---|---|---|---|
| Matching Percent Similarity: | 100.00 | Matching Percent Identity: | 100.00 |
| Total Percent Similarity: | 75.94 | Total Percent Identity: | 75.94 |
| Gaps: | 1 | | |

Alignment:

```
  1   MAPLRPLLILALLAWVALADQESCKGRCTEGFNVDKKCQCDELCSYYQSC    50
      ||||||||||||||||||||||||||||||||||||||||||||||||||
  1   MAPLRPLLILALLAWVALADQESCKGRCTEGFNVDKKCQCDELCSYYQSC    50

51   CTDYTAECKPQVTRGDVFTMPEDEYTVYDDGEEKNNATVHEQVGGPSLTS   100
      ||||||||||||||||||||||||||||||||||||||||||||||||||
 51   CTDYTAECKPQVTRGDVFTMPEDEYTVYDDGEEKNNATVHEQVGGPSLTS   100

101   DLQAQSKGNPEQTPVLKPEEEAPAPEVGASKPEGIDSRPETLHPGRPQPP   150
      ||||||||||||||||||||||||||||||||||||||||||||||||||
101   DLQAQSKGNPEQTPVLKPEEEAPAPEVGASKPEGIDSRPETLHPGRPQPP   150

151   AEEELCSGKPFDAFTDLKNGSLFAFRGQYCYELDEKAVRPGYPKLIRDVW   200
      ||||||||||||||||||||||||||||||||||||||||||||||||||
151   AEEELCSGKPFDAFTDLKNGSLFAFRGQYCYELDEKAVRPGYPKLIRDVW   200

201   GIEGPIDAAFTRINCQGKTYLFKGSQYWRFEDGVLDPDYPRNISDGFDGI   250
      ||||||||||||||||||||||||||||||||||||||||||||||||||
201   GIEGPIDAAFTRINCQGKTYLFKGSQYWRFEDGVLDPDYPRNISDGFDGI   250

251   PDNVDAALALPAHSYSGRERVYFFKGKQYWEYQFQHQPSQEECEGSSLSA   300
      ||||||||||||||||||||||||||||||||||||||||||||||||||
251   PDNVDAALALPAHSYSGRERVYFFKGKQYWEYQFQHQPSQEECEGSSLSA   300

301   VFEHFAMMQRDSWEDIFELLFWGRTS........................   326
      |||||||||||||||||||||||||
301   VFEHFAMMQRDSWEDIFELLFWGRTSAGTRQPQFISRDWHGVPGQVDAAM   350

326   ..................................................   326

351   AGRIYISGMAPRPSLAKKQRFRHRNRKGYRSQRGHSRGRNQNSRRPSRAT   400

327   ...........................................DKYYRVNLR   335
                                                 |||||||||
401   WLSLFSSEESNLGANNYDDYRMDWLVPATCEPIQSVFFFSGDKYYRVNLR   450

336   TRRVDTVDPPYPRSIAQYWLGCPAPGHL                       363
      ||||||||||||||||||||||||||||
451   TRRVDTVDPPYPRSIAQYWLGCPAPGHL                       478
```

Sequence name: /tmp/fgebv7ir4i/48bTBMziJ0:VTNC_HU-
MAN (SEQ ID NO:1418)
Sequence documentation:
Alignment of: T399711P12 (SEQ ID NO:1288) x
VTNC_HUMAN (SEQ ID NO:1418) ..
Alignment segment 1/1:

| Quality: | 2237.00 | Escore: | 0 |
|---|---|---|---|
| Matching length: | 223 | Total length: | 223 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1   MAPLRPLLILALLAWVALADQESCKGRCTEGFNVDKKCQCDELCSYYQSC   50
      ||||||||||||||||||||||||||||||||||||||||||||||||||
  1   MAPLRPLLILALLAWVALADQESCKGRCTEGFNVDKKCQCDELCSYYQSC   50

51   CTDYTAECKPQVTRGDVFTMPEDEYTVYDDGEEKNNATVHEQVGGPSLTS  100
      ||||||||||||||||||||||||||||||||||||||||||||||||||
 51   CTDYTAECKPQVTRGDVFTMPEDEYTVYDDGEEKNNATVHEQVGGPSLTS  100

101   DLQAQSKGNPEQTPVLKPEEEAPAPEVGASKPEGIDSRPETLHPGRPQPP  150
      ||||||||||||||||||||||||||||||||||||||||||||||||||
101   DLQAQSKGNPEQTPVLKPEEEAPAPEVGASKPEGIDSRPETLHPGRPQPP  150

151   AEEELCSGKPFDAFTDLKNGSLFAFRGQYCYELDEKAVRPGYPKLIRDVW  200
      ||||||||||||||||||||||||||||||||||||||||||||||||||
151   AEEELCSGKPFDAFTDLKNGSLFAFRGQYCYELDEKAVRPGYPKLIRDVW  200

201   GIEGPIDAAFTRINCQGKTYLFK  223
      |||||||||||||||||||||||
201   GIEGPIDAAFTRINCQGKTYLFK  223
```

Sequence name: /tmp/fgebv7ir4i/48bTBMziJ0:Q9BSH7
Sequence documentation:

Alignment of: T39971_P12 (SEQ ID NO:1288) x Q9BSH7 ..
Alignment segment 1/1:

| Quality: | 2237.00 | Escore: | 0 |
|---|---|---|---|
| Matching length: | 223 | Total length: | 223 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MAPLRPLLILALLAWVALADQESCKGRCTEGFNVDKKCQCDELCSYYQSC   50
     ||||||||||||||||||||||||||||||||||||||||||||||||||
  1  MAPLRPLLILALLAWVALADQESCKGRCTEGFNVDKKCQCDELCSYYQSC   50

51  CTDYTAECKPQVTRGDVFTMPEDEYTVYDDGEEKNNATVHEQVGGPSLTS  100
     ||||||||||||||||||||||||||||||||||||||||||||||||||
 51  CTDYTAECKPQVTRGDVFTMPEDEYTVYDDGEEKNNATVHEQVGGPSLTS  100

101  DLQAQSKGNPEQTPVLKPEEEAPAPEVGASKPEGIDSRPETLHPGRPQPP  150
     ||||||||||||||||||||||||||||||||||||||||||||||||||
101  DLQAQSKGNPEQTPVLKPEEEAPAPEVGASKPEGIDSRPETLHPGRPQPP  150

151  AEEELCSGKPFDAFTDLKNGSLFAFRGQYCYELDEKAVRPGYPKLIRDVW  200
     ||||||||||||||||||||||||||||||||||||||||||||||||||
151  AEEELCSGKPFDAFTDLKNGSLFAFRGQYCYELDEKAVRPGYPKLIRDVW  200

201  GIEGPIDAAFTRINCQGKTYLFK                             223
     |||||||||||||||||||||||
201  GIEGPIDAAFTRINCQGKTYLFK                             223
```

Description for Cluster Z21368

Cluster Z21368 features 7 transcript(s) and 34 segment(s) of interest, the names for which are given in Tables 82 and 83, respectively, the sequences themselves are given at the end of the application. The selected protein variants are given in table 84.

TABLE 82

Transcripts of interest

| Transcript Name | Sequence ID No. |
| --- | --- |
| Z21368_PEA_1_T10 | 9 |
| Z21368_PEA_1_T11 | 10 |
| Z21368_PEA_1_T23 | 11 |
| Z21368_PEA_1_T24 | 12 |
| Z21368_PEA_1_T5 | 13 |
| Z21368_PEA_1_T6 | 14 |
| Z21368_PEA_1_T9 | 15 |

TABLE 83

Segments of interest

| Segment Name | Sequence ID No. |
| --- | --- |
| Z21368_PEA_1_node_0 | 1067 |
| Z21368_PEA_1_node_15 | 1068 |
| Z21368_PEA_1_node_19 | 1069 |
| Z21368_PEA_1_node_2 | 1070 |
| Z21368_PEA_1_node_21 | 1071 |
| Z21368_PEA_1_node_33 | 1072 |
| Z21368_PEA_1_node_36 | 1073 |
| Z21368_PEA_1_node_37 | 1074 |
| Z21368_PEA_1_node_39 | 1075 |
| Z21368_PEA_1_node_4 | 1076 |
| Z21368_PEA_1_node_41 | 1077 |
| Z21368_PEA_1_node_43 | 1078 |
| Z21368_PEA_1_node_45 | 1079 |
| Z21368_PEA_1_node_53 | 1080 |
| Z21368_PEA_1_node_56 | 1081 |
| Z21368_PEA_1_node_58 | 1082 |
| Z21368_PEA_1_node_66 | 1083 |
| Z21368_PEA_1_node_67 | 1084 |
| Z21368_PEA_1_node_69 | 1085 |
| Z21368_PEA_1_node_11 | 1086 |
| Z21368_PEA_1_node_12 | 1087 |
| Z21368_PEA_1_node_16 | 1088 |
| Z21368_PEA_1_node_17 | 1089 |

TABLE 83-continued

Segments of interest

| Segment Name | Sequence ID No. |
| --- | --- |
| Z21368_PEA_1_node_23 | 1090 |
| Z21368_PEA_1_node_24 | 1091 |
| Z21368_PEA_1_node_30 | 1092 |
| Z21368_PEA_1_node_31 | 1093 |
| Z21368_PEA_1_node_38 | 1094 |
| Z21368_PEA_1_node_47 | 1095 |
| Z21368_PEA_1_node_49 | 1096 |
| Z21368_PEA_1_node_51 | 1097 |
| Z21368_PEA_1_node_61 | 1098 |
| Z21368_PEA_1_node_68 | 1099 |
| Z21368_PEA_1_node_7 | 1100 |

TABLE 84

Proteins of interest

| Protein Name | Sequence ID No. |
| --- | --- |
| Z21368_PEA_1_P2 | 1289 |
| Z21368_PEA_1_P5 | 1290 |
| Z21368_PEA_1_P15 | 1291 |
| Z21368_PEA_1_P16 | 1292 |
| Z21368_PEA_1_P22 | 1293 |
| Z21368_PEA_1_P23 | 1294 |

These sequences are variants of the known protein Extracellular sulfatase Sulf-1 precursor (SwissProt accession identifier SUL1_HUMAN; known also according to the synonyms EC 3.1.6.-; HSulf-1), SEQ ID NO: 1419, referred to herein as the previously known protein.

Protein Extracellular sulfatase Sulf-1 precursor (SEQ ID NO:1419) is known or believed to have the following function(s): Exhibits arylsulfatase activity and highly specific endoglucosamine-6-sulfatase activity. It can remove sulfate from the C-6 position of glucosamine within specific subregions of intact heparin. Diminishes HSPG (heparan sulfate proteoglycans) sulfation, inhibits signaling by heparin-dependent growth factors, diminishes proliferation, and facilitates apoptosis in response to exogenous stimulation. The sequence for protein Extracellular sulfatase Sulf-1 precursor is given at the end of the application, as "Extracellular sulfatase Sulf-1 precursor amino acid sequence". Known polymorphisms for this sequence are as shown in Table 85.

TABLE 85

Amino acid mutations for Known Protein

| SNP position(s) on amino acid sequence | Comment |
|---|---|
| 87-88 | CC->AA: LOSS OF ARYLSULFATASE ACTIVITY AND LOSS OF ABILITY TO MODULATE APOPTOSIS. |
| 49 | L -> P |
| 728 | K -> R |

Protein Extracellular sulfatase Sulf-1 precursor (SEQ ID NO:1419) localization is believed to be Endoplasmic reticulum and Golgi stack. Also localized on the cell surface (By similarity).

The following GO Annotation(s) apply to the previously known protein. The following annotation(s) were found: apoptosis; metabolism; heparan sulfate proteoglycan metabolism, which are annotation(s) related to Biological Process; arylsulfatase; hydrolase, which are annotation(s) related to Molecular Function; and extracellular space; endoplasmic reticulum; Golgi apparatus, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster Z21368 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 13 refer to weighted expression of ESTs in each category, as "parts per million" (ratio of the expression of ESTs for a particular cluster to the expression of all ESTs in that category, according to parts per million).

Figure 13:
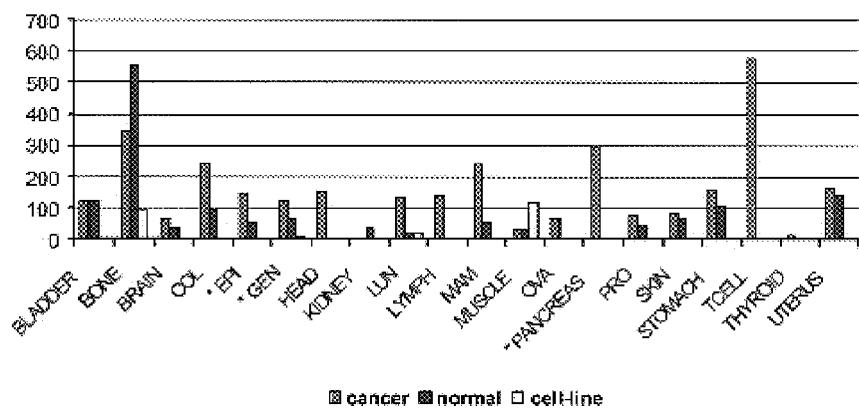
FIG. 13 is a histogram showing Cancer and cell-line vs. normal tissue expression for Cluster Z21368, demonstrating overexpression in epithelial malignant tumors, a mixture of malignant tumors from different tissues and pancreas carcinoma.

Overall, the following results were obtained as shown with regard to the histograms in FIG. 13 and Table 86. This cluster is overexpressed (at least at a minimum level) in the following pathological conditions: epithelial malignant tumors, a mixture of malignant tumors from different tissues and pancreas carcinoma.

TABLE 86

Normal tissue distribution

| Name of Tissue | Number |
|---|---|
| bladder | 123 |
| Bone | 557 |
| Brain | 34 |
| Colon | 94 |
| epithelial | 56 |
| general | 68 |
| head and neck | 0 |
| kidney | 35 |
| Lung | 22 |
| Lymph nodes | 0 |
| Breast | 52 |
| muscle | 31 |
| Ovary | 0 |
| pancreas | 0 |
| prostate | 44 |
| Skin | 67 |
| stomach | 109 |

TABLE 86-continued

Normal tissue distribution

| Name of Tissue | Number |
|---|---|
| T cells | 0 |
| Thyroid | 0 |
| Uterus | 140 |

TABLE 87

P values and ratios for expression in cancerous tissue

| Name of Tissue | P1 | P2 | SP1 | R3 | SP2 | R4 |
|---|---|---|---|---|---|---|
| bladder | 5.4e−01 | 6.6e−01 | 6.4e−01 | 1.0 | 8.5e−01 | 0.7 |
| Bone | 4.5e−01 | 8.2e−01 | 9.1e−01 | 0.4 | 1 | 0.3 |
| Brain | 5.5e−01 | 7.3e−01 | 1.5e−01 | 1.5 | 5.0e−01 | 0.9 |
| Colon | 1.4e−01 | 2.8e−01 | 1.0e−01 | 2.0 | 3.0e−01 | 1.4 |
| epithelial | 1.1e−03 | 1.5e−01 | 1.2e−07 | 2.1 | 1.0e−01 | 1.1 |
| general | 1.4e−05 | 5.3e−02 | 1.9e−06 | 1.6 | 6.7e−01 | 0.8 |
| head and neck | 2.4e−02 | 7.1e−02 | 4.6e−01 | 2.5 | 7.5e−01 | 1.4 |
| kidney | 8.9e−01 | 9.0e−01 | 1 | 0.4 | 1 | 0.4 |
| Lung | 3.5e−01 | 4.1e−01 | 7.2e−03 | 2.6 | 1.0e−01 | 1.6 |
| Lymph nodes | 7.7e−02 | 3.1e−01 | 2.3e−02 | 8.5 | 1.9e−01 | 3.2 |
| Breast | 4.0e−01 | 6.1e−01 | 5.4e−02 | 2.3 | 3.0e−01 | 1.3 |
| muscle | 7.5e−02 | 3.5e−02 | 1 | 1.0 | 1.7e−01 | 1.7 |
| Ovary | 3.8e−01 | 4.2e−01 | 2.2e−01 | 2.9 | 3.4e−01 | 2.2 |
| pancreas | 2.2e−02 | 6.9e−02 | 1.4e−08 | 6.5 | 1.4e−06 | 4.6 |
| prostate | 8.3e−01 | 8.9e−01 | 3.1e−01 | 1.4 | 5.2e−01 | 1.1 |
| Skin | 6.1e−01 | 8.1e−01 | 6.0e−01 | 1.2 | 1 | 0.3 |
| stomach | 4.4e−02 | 5.0e−01 | 5.0e−01 | 0.8 | 9.7e−01 | 0.4 |
| T cells | 5.0e−01 | 6.7e−01 | 3.3e−01 | 3.1 | 7.2e−01 | 1.4 |
| Thyroid | 3.6e−01 | 3.6e−01 | 1 | 1.1 | 1 | 1.1 |
| Uterus | 3.5e−01 | 7.8e−01 | 4.6e−01 | 0.9 | 9.1e−01 | 0.5 |

As noted above, cluster Z21368 features 7 transcript(s), which were listed in Table 1 above. These transcript(s) encode for protein(s) which are variant(s) of protein Extracellular sulfatase Sulf-1 precursor (SEQ ID NO:1419). A description of each variant protein according to the present invention is now provided.

Variant protein Z21368_PEA_1_P2 (SEQ ID NO:1289) according to the present invention has an amino acid sequence as given at the end of the application; it is encoded by transcript(s) Z21368_PEA_1_T5 (SEQ ID NO:13). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison Report Between Z21368_PEA_1_P2 (SEQ ID NO:1289 and SUL1_HUMAN (SEQ ID NO:1419):

1. An isolated chimeric polypeptide encoding for Z21368_PEA_1_P2 (SEQ ID NO:1289), comprising a first amino acid sequence being at least 90% homologous to MKYSCCALVLAVLGTELLGSLCSTVR-
SPRFRGRIQQERKNIRPNIILVLTDDQDVELGSL
QVMNKTRKIMEHGGATFINAFVTTPMC-
CPSRSSMLTGKYVHNHNVYTNNENCSSPSW QAM-
HEPRTFAVYLNNTGYRTAFFGKYLNEY-
NGSYIPPGWREWLGLIKNSRFYNYTVCR
NGIKEKHGFDYAKDYFTDLITNESINY-
FKMSKRMYPHRPVMMVISHAAPHGPEDSAPQ
FSKLYPNASQHITPSYNYAPNMDKHWIM-
QYTGPMLPIHMEFTNILQRKRLQTLMSVDD SVER-
LYNMLVETGELENTYIIYTADHGY- HIGQFGLVKGKSMPYDFDIRVPFFIRGPSVEP GSIVPQIVLNIDLAPTILDIAGLDTPPD-VDGKSVLKLLDPEKPGNRFRTNKKAKIWRDTFL VERGKFLRKKEESSKNIQQSNHLPKY-ERVKELCQQARYQTACEQPGQKWQCIEDTSGK LRI-HKCKGPSDLLTVRQSTRNLYARGFHDKD-KECSCRESGYRASRSQRKSQRQFLRNQ GTPKYKPRFVHTRQTRSLSVEFEGEIY-DINLEEEEELQVLQPRNIAKRHDEGHKGPRDLQ ASSGGNRGRMLADSSNAVGPPTTVRVTH-KCFILPNDSIHCERELYQSARAWKDHKAYI DKEIEALQDKIKNLREVRGHLKRRK-PEECSCSKQSYYNKEKGVKKQEKLKSHLHPFKE AAQEVDSKLQLFKENNRRRK-KERKEKRRQRKGEECSLPGLTCFTHDN-NHWQTAPFWN corresponding to amino acids 1-761 of SUL1_HUMAN (SEQ ID NO:1419), which also corresponds to amino acids 1-761 of Z21368_PEA__1_P2 (SEQ ID NO:1289), and a second amino acid sequence being at least 70%, optionally at least 80%, preferably at least 85%, more preferably at least 90% and most preferably at least 95% homologous to a polypeptide having the sequence PHKYSAHGRTRHFESATRTTNGAQKLSRI (SEQ ID NO:1759) corresponding to amino acids 762-790 of Z21368_PEA__1_P2 (SEQ ID NO:1289), wherein said first and second amino acid sequences are contiguous and in a sequential order.

2. An isolated polypeptide encoding for a tail of Z21368_PEA__1_P2 (SEQ ID NO:1289), comprising a polypeptide being at least 70%, optionally at least about 80%, preferably at least about 85%, more preferably at least about 90% and most preferably at least about 95% homologous to the sequence PHKYSAHGRTRHFESATRTTNGAQKLSRI (SEQ ID NO: 1759) in Z21368_PEA__1_P2 (SEQ ID NO:1289).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA__1_P2 (SEQ ID NO:1289) is encoded by the following transcript(s): Z21368_PEA__1_T5 (SEQ ID NO:13), for which the sequence(s) is/are given at the end of the application. The coding portion of transcript Z21368_PEA__1_T5 (SEQ ID NO:13) is shown in bold; this coding portion starts at position 529 and ends at position 2898.

Variant protein Z21368_PEA__1_P5 (SEQ ID NO:1290) according to the present invention has an amino acid sequence as given at the end of the application; it is encoded by transcript(s) Z21368_PEA__1_T9 (SEQ ID NO:15). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison Report Between Z21368_PEA__1_P5 (SEQ ID NO:1290) and Q7Z2W2 (SEQ ID NO:1697):

1. An isolated chimeric polypeptide encoding for Z21368_PEA__1_P5 (SEQ ID NO:1290) comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of Q7Z2W2 (SEQ ID NO:1697), which also corresponds to amino acids 1-57 of Z21368_PEA__1_P5 (SEQ ID NO:1290), second bridging amino acid sequence comprising A, and a third amino acid sequence being at least 90% homologous to FFGKYLNEY-NGSYIPPGWREWLGLIKNSRFYNY-TVCRNGIKEKHGFDYAKDYFTDLITN ESINYFKM-SKRMYPHRPVMMVISHAAPHGPEDSAPQFSKLYPNA SQHITPSYNYAPNM DKHWIMQYTGPMLPIHMEFT-NILQRKRLQTLMSVDDSVERLYNMLVET-GELENTYIIYT ADHGYHIGQFGLVKGKSMPYD-FDIRVPFFIRGPSVEPGSIVPQIVLNIDLAPTILDIAGLDT PPDVDGKSVLKLLDPEKPGNRFRT-NKKAKIWRDTFLVERGKFLRKKEESSKNIQQSNHL PKYERVKELCQQARYQTACEQPGQK-WQCIEDTSGKLRIHKCKGPSDLLTVRQSTRNLY ARG-FHDKDKECSCRESGYRASRSQRKSQRQ-FLRNQGTPKYKPRFVHTRQTRSLSVEFE GEIYDINLEEEEELQVLQPRNIAKRHDE-GHKGPRDLQASSGGNRGRMLADSSNAVGPPT TVRVTHKCFILPNDSIHCERELYQSA-RAWKDHKAYIDKEIEALQDKIKNLREVRGHLKR RKPEECSCSKQSYYNKEKGVKKQEKLK-SHLHPFKEAAQEVDSKLQLFKENNRRRKKER KEKRRQRKGEECSLPGLTCFTHDN-NHWQTAPFWNLGSFCACTSSNNNTYWCLRTVNE THNFLFCEFATGFLEYFDMNTDPYQLT-NTVHTVERGILNQLHVQLMELRSCQGYKQCN PRP-KNLDVGNKDGGSYDLHRGQLWDGWEG corresponding to amino acids 139-871 of Q7Z2W2 (SEQ ID NO:1697), which also corresponds to amino acids 59-791 of Z21368_PEA__1_P5 (SEQ ID NO:1290), wherein said first, second and third amino acid sequences are contiguous and in a sequential order.

2. An isolated polypeptide encoding for an edge portion of Z21368_PEA__1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise LAF, the sequence having a structure as follows (numbering according to Z21368_PEA__1_P5 (SEQ ID NO:1290)): a sequence starting from any of amino acid numbers 57−x to 57; and ending at any of amino acid numbers 59+((n−2)−x), in which x varies from 0 to n−2.

Comparison Report Between Z21368_PEA__1_P5 (SEQ ID NO:1290) and AAH12997 (SEQ ID NO:1698):

1. An isolated chimeric polypeptide encoding for Z21368_PEA__1_P5 (SEQ ID NO:1290), comprising a first amino acid sequence being at least 70%, optionally at least 80%, preferably at least 85%, more preferably at least 90% and most preferably at least 95% homologous to a polypeptide having the sequence MKYSCCALVLAVLG-TELLGSLCSTVRSPRFRGRIQQERKNIR-PNIILVLTDDQDVELAFF GKYLNEYNGSYIPPGWREWLGLIKNSR- FYNYTVCRNGIKEKHGFDYAKDYFTDLITNES INY-
FKMSKRMYPHRPVMMVISHAAPHGPED-
SAPQFSKLYPNASQHITPSYNYAPNMDK
HWIMQYTGPMLPIHMEFT-
NILQRKRLQTLMSVDDSVERLYNMLVET-
GELENTYIIYTAD HGYHIGQFGLVKGKSMPYD-
FDIRVPFFIRGPSVEPGSIVPQIVLNIDLAPTILDIAGL
DTPP DVDGKSVLKLLDPEKPGNRFRTNKKAKI-
WRDTFLVERGKFLRKKEESSKNIQQSNHLP
KYERVKELCQQARYQTACEQPGQK-
WQCIEDTSGKLRIHKCKGPSDLLTVRQSTRNLYA
RGFHDKDKECSCRESGYRASRSQRK-
SQRQFLRNQGTPKYKPRFVHTRQTRSLSVEFEGE
IYDINLEEEEELQVLQPRNIAKRHDEGH-
KGPRDLQASSGGNRGRMLADSSNAVGPPTTV RVTH-
KCFILPNDSIHCERELYQSARAWKDH-
KAYIDKEIEALQDKIKNLREVRGHLKRRK
PEECSCSKQSYYNKEKGVKKQEKLKSHL-
HPFKEAAQEVDSKLQLFKENNRRRKKERKE
KRRQRKGEECSLPGLTCFTHDN-
NHWQTAPFWNLGSFCACTSSNNNTYWCLRTVNETH
NFLFCEFATGFLEYFDMNTDPYQLT-
NTVHTVERGILNQLHVQLME (SEQ ID NO:1760) corresponding to amino acids 1-751 of Z21368_PEA_1_P5 (SEQ ID NO:1290), and a second amino acid sequence being at least 90% homologous to LRSCQGYKQCNPRPKNLD-VGNKDGGSYDLHRGQLWDGWEG corresponding to amino acids 1-40 of AAH12997 (SEQ ID NO:1698), which also corresponds to amino acids 752-791 of Z21368_PEA_1_P5 (SEQ ID NO:1290), wherein said first and second amino acid sequences are contiguous and in a sequential order.

2. An isolated polypeptide encoding for a head of Z21368_PEA_1_P5 (SEQ ID NO:1290), comprising a polypeptide being at least 70%, optionally at least about 80%, preferably at least about 85%, more preferably at least about 90% and most preferably at least about 95% homologous to the sequence MKYSCCALVLAVLGTELLGSLCSTVR-SPRFRGRIQQERKNIRPNIILVLTDDQDVELAFF GKY-LNEYNGSYIPPGWREWLGLIKNSRFYNY-
TVCRNGIKEKHGFDYAKDYFTDLITNES
INYFKMSKRMYPHRPVMMVISHAAPHG-
PEDSAPQFSKLYPNASQHITPSYNYAPNMDK HWIM-
QYTGPMLPIHMEFTNILQRKRLQTLMS-
VDDSVERLYNMLVETGELENTYIIYTAD
HGYHIGQFGLVKGKSMPYD-
FDIRVPFFIRGPSVEPGSIVPQIVLNID-
LAPTILDIAGLDTPP DVDGKSVLKLLDPEKPGNRFRT-
NKKAKIWRDTFLVERGKFLRKKEESSKNIQQSNHLP
KYERVKELCQQARYQTACEQPGQK-
WQCIEDTSGKLRIHKCKGPSDLLTVRQSTRNLYA
RGFHDKDKECSCRESGYRASRSQRK-
SQRQFLRNQGTPKYKPRFVHTRQTRSLSVEFEGE
IYDINLEEEEELQVLQPRNIAKRHDEGH-
KGPRDLQASSGGNRGRMLADSSNAVGPPTTV RVTH-
KCFILPNDSIHCERELYQSARAWKDH-
KAYIDKEIEALQDKIKNLREVRGHLKRRK
PEECSCSKQSYYNKEKGVKKQEKLKSHL-
HPFKEAAQEVDSKLQLFKENNRRRKKERKE
KRRQRKGEECSLPGLTCFTHDN-
NHWQTAPFWNLGSFCACTSSNNNTYWCLRTVNETH
NFLFCEFATGFLEYFDMNTDPYQLT-
NTVHTVERGILNQLHVQLME (SEQ ID NO:1760) of Z21368_PEA_1_P5 (SEQ ID NO:1290).

Comparison Report Between Z21368_PEA_1_P5 (SEQ ID NO:1290) and SUL1_HUMAN (SEQ ID NO:1419):

1. An isolated chimeric polypeptide encoding for Z21368_PEA_1_P5 (SEQ ID NO:1290), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of SUL1_HUMAN (SEQ ID NO:1419), which also corresponds to amino acids 1-57 of Z21368_PEA_1_P5 (SEQ ID NO:1290), and a second amino acid sequence being at least 90% homologous to AFF-GKYLNEYNGSYIPPGWREWLGLIKNSR-
FYNYTVCRNGIKEKHGFDYAKDYFTDLIT NESINY-
FKMSKRMYPHRPVMMVISHAAPHGPEDSAPQFSKL
YPNASQHITPSYNYAPN MDKHWIMQYTGPMLPIH-
MEFTNILQRKRLQTLMSVDDSVERLYNM-
LVETGELENTYII YTADHGYHIGQFGLVKGKSMPYD-
FDIRVPFFIRGPSVEPGSIVPQIVLNIDLAPTILDIAGL
DTPPDVDGKSVLKLLDPEKPGNRFRT-
NKKAKIWRDTFLVERGKFLRKKEESSKNIQQSN HLP-
KYERVKELCQQARYQTACEQPGQK-
WQCIEDTSGKLRIHKCKGPSDLLTVRQSTRN
LYARGFHDKDKECSCRESGYRASRSQRK-
SQRQFLRNQGTPKYKPRFVHTRQTRSLSVE FEGEIY-
DINLEEEEELQVLQPRNIAKRHDEGHKG-
PRDLQASSGGNRGRMLADSSNAVGP
PTTVRVTHKCFILPNDSIHCERELYQSA-
RAWKDHKAYIDKEIEALQDKIKNLREVRGHL KRRK-
PEECSCSKQSYYNKEKGVKKQEKLKSHL-
HPFKEAAQEVDSKLQLFKENNRRRK
KERKEKRRQRKGEECSLPGLTCFTHDN-
NHWQTAPFWNLGSFCACTSSNNNTYWCLRT
VNETHNFLFCEFATGFLEYFDMNTD-
PYQLTNTVHTVERGILNQLHVQLMELRSCQGYK
QCNPRPKNLDVGNKDGGSYDLHRGQLWDGWEG
corresponding to amino acids 138-871 of SUL1_HUMAN (SEQ ID NO:1419), which also corresponds to amino acids 58-791 of Z21368_PEA_1_P5 (SEQ ID NO:1290), wherein said first and second amino acid sequences are contiguous and in a sequential order.

2. An isolated chimeric polypeptide encoding for an edge portion of Z21368_PEA_1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LA, having a structure as follows: a sequence starting from any of amino acid numbers 57–x to 57; and ending at any of amino acid numbers 58+((n–2)–x), in which x varies from 0 to n–2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P5 (SEQ ID NO:1290) is encoded by the following transcript(s): Z21368_PEA_1_T9 (SEQ ID NO:15), for which the sequence(s) is/are given at the end of the application. The coding portion of transcript Z21368_PEA_1_T9 (SEQ ID NO:15) is shown in bold; this coding portion starts at position 556 and ends at position 2928.

Variant protein Z21368_PEA_1_P15 (SEQ ID NO:1291) according to the present invention has an amino acid sequence as given at the end of the application; it is encoded by transcript(s) Z21368_PEA_1_T23 (SEQ ID NO:11). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison Report Between Z21368_PEA_1_P15 (SEQ ID NO:1291) and SUL1_HUMAN (SEQ ID NO:1419):

1. An isolated chimeric polypeptide encoding for Z21368_PEA_1_P15 (SEQ ID NO:1291), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHAAPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNRFRTNKKAKIWRDTFL VERG corresponding to amino acids 1-416 of SUL1_HUMAN (SEQ ID NO:1419), which also corresponds to amino acids 1-416 of Z21368_PEA_1_P15 (SEQ ID NO:1291).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P15 (SEQ ID NO:1291) is encoded by the following transcript(s): Z21368_PEA_1_T23 (SEQ ID NO:11), for which the sequence(s) is/are given at the end of the application. The coding portion of transcript Z21368_PEA_1_T23 (SEQ ID NO:11) is shown in bold; this coding portion starts at position 691 and ends at position 1938.

Variant protein Z21368_PEA_1_P16 (SEQ ID NO:1292) according to the present invention has an amino acid sequence as given at the end of the application; it is encoded by transcript(s) Z21368_PEA_1_T24 (SEQ ID NO:12). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison Report Between Z21368_PEA_1_P16 (SEQ ID NO:1292) and SUL1_HUMAN (SEQ ID NO:1419):

1. An isolated chimeric polypeptide encoding for Z21368_PEA_1_P16 (SEQ ID NO:1292), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRTAFFGKYLNEY-NGSYIPPGWREWLGLIKNSRFYNYTVCR NGIKEKHGFDYAKDYFTDLITNESINY-FKMSKRMYPHRPVMMVISHAAPHGPEDSAPQ FSKLYPNASQHITPSYNYAPNMDKHWIM-QYTGPMLPIHMEFTNILQRKRLQTLMSVDD SVER-LYNMLVETGELENTYIIYTADHGY-HIGQFGLVKGKSMPYDFDIRVPFFIRGPSVEP GSIVPQIVLNIDLAPTILDIAGLDTPPD-VDGKSVLKLLDPEKPGNR corresponding to amino acids 1-397 of SUL1_HUMAN (SEQ ID NO:1419), which also corresponds to amino acids 1-397 of Z21368_PEA_1_P16 (SEQ ID NO:1292), and a second amino acid sequence being at least 70%, optionally at least 80%, preferably at least 85%, more preferably at least 90% and most preferably at least 95% homologous to a polypeptide having the sequence CVIVPPLSQPQIH (SEQ ID NO:1761) corresponding to amino acids 398-410 of Z21368_PEA_1_P16 (SEQ ID NO:1292), wherein said first and second amino acid sequences are contiguous and in a sequential order.

2. An isolated polypeptide encoding for a tail of Z21368_PEA_1_P16 (SEQ ID NO:1292), comprising a polypeptide being at least 70%, optionally at least about 80%, preferably at least about 85%, more preferably at least about 90% and most preferably at least about 95% homologous to the sequence CVIVPPLSQPQIH (SEQ ID NO:1761) in Z21368_PEA_1_P16 (SEQ ID NO:1292).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P16 (SEQ ID NO:1292) is encoded by the following transcript(s): Z21368_PEA_1_T24 (SEQ ID NO:12), for which the sequence(s) is/are given at the end of the application. The coding portion of transcript Z21368_PEA_1_T24 (SEQ ID NO:12) is shown in bold; this coding portion starts at position 691 and ends at position 1920.

Variant protein Z21368_PEA_1_P22 (SEQ ID NO:1293) according to the present invention has an amino acid sequence as given at the end of the application; it is encoded by transcript(s) Z21368_PEA_1_T10 (SEQ ID NO:9). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison Report Between Z21368_PEA_1_P22 (SEQ ID NO:1293) and SUL1_HUMAN (SEQ ID NO:1419):

1. An isolated chimeric polypeptide encoding for Z21368_PEA_1_P22 (SEQ ID NO:1293), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC- CPSRSSMLTGKYVHNHNVYTNNENCSSPSW QAM-HEPRTFAVYLNNTGYRTAFFGKYLNEY-NGSYIPPGWREWLGLIKNSRFYNYTVCR NGIKEKHGFDYAK corresponding to amino acids 1-188 of SUL1_HUMAN (SEQ ID NO:1419), which also corresponds to amino acids 1-188 of Z21368_PEA_1_P22 (SEQ ID NO:1293), and a second amino acid sequence being at least 70%, optionally at least 80%, preferably at least 85%, more preferably at least 90% and most preferably at least 95% homologous to a polypeptide having the sequence ARYDGDQPRCAPRPRGLSPTVF (SEQ ID NO:1762) corresponding to amino acids 189-210 of Z21368_PEA_1_P22 (SEQ ID NO:1293), wherein said first and second amino acid sequences are contiguous and in a sequential order.

2. An isolated polypeptide encoding for a tail of Z21368_PEA_1_P22 (SEQ ID NO:1293), comprising a polypeptide being at least 70%, optionally at least about 80%, preferably at least about 85%, more preferably at least about 90% and most preferably at least about 95% homologous to the sequence ARYDGDQPRCAPRPRGLSPTVF (SEQ ID NO:1762) in Z21368_PEA_1_P22 (SEQ ID NO:1293).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P22 (SEQ ID NO:1293) is encoded by the following transcript(s): Z21368_PEA_1_T10 (SEQ ID NO:9), for which the sequence(s) is/are given at the end of the application. The coding portion of transcript Z21368_PEA_1_T10 (SEQ ID NO:9) is shown in bold; this coding portion starts at position 691 and ends at position 1320.

Variant protein Z21368_PEA_1_P23 (SEQ ID NO:1294) according to the present invention has an amino acid sequence as given at the end of the application; it is encoded by transcript(s) Z21368_PEA_1_T11 (SEQ ID NO:10). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison Report Between Z21368_PEA_1_P23 (SEQ ID NO:1294) and Q7Z2W2 (SEQ ID NO:1697):

1. An isolated chimeric polypeptide encoding for Z21368_PEA_1_P23 (SEQ ID NO:1294), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRT corresponding to amino acids 1-137 of Q7Z2W2 (SEQ ID NO:1697), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1763) corresponding to amino acids 138-145 of Z21368_PEA_1_P23 (SEQ ID NO:1294), wherein said first and second amino acid sequences are contiguous and in a sequential order.

2. An isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO:1763) in Z21368_PEA_1_P23 (SEQ ID NO:1294).

Comparison Report Between Z21368_PEA_1_P23 (SEQ ID NO:1294) and SUL1_HUMAN (SEQ ID NO:1419):

1. An isolated chimeric polypeptide encoding for Z21368_PEA_1_P23 (SEQ ID NO:1294), comprising a first amino acid sequence being at least 90% homologous to MKYSCCALVLAVLGTELLGSLCSTVR-SPRFRGRIQQERKNIRPNIILVLTDDQDVELGSL QVMNKTRKIMEHGGATFINAFVTTPMC-CPSRSSMLTGKYVHNHNVYTNNENCSSPSW QAM-HEPRTFAVYLNNTGYRT corresponding to amino acids 1-137 of SUL1_HUMAN (SEQ ID NO:1419), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1763) corresponding to amino acids 138-145 of Z21368_PEA_1_P23 (SEQ ID NO:1294), wherein said first and second amino acid sequences are contiguous and in a sequential order.

2. An isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO:1763) in Z21368_PEA_1_P23 (SEQ ID NO:1294).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P23 (SEQ ID NO:1294) is encoded by the following transcript(s): Z21368_PEA_1_T11 (SEQ ID NO:10), for which the sequence(s) is/are given at the end of the application. The coding portion of transcript Z21368_PEA_1_T11 (SEQ ID NO:10) is shown in bold; this coding portion starts at position 691 and ends at position 1125.

As noted above, cluster Z21368 features 34 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z21368_PEA_1_node_0 (SEQ ID NO:1067) according to the present invention is supported by 8 libraries. The number of libraries was determined as previously described. This segment can be found in the following transcript(s): Z21368_PEA_1_T9 (SEQ ID NO:15). Table 88 below describes the starting and ending position of this segment on each transcript.

TABLE 88

Segment location on transcripts

| Transcript name | Segment starting position | Segment ending position |
|---|---|---|
| Z21368_PEA_1_T9 (SEQ ID NO: 15) | 1 | 327 |

Segment cluster Z21368_PEA_1_node_15 (SEQ ID NO:1068) according to the present invention is supported by 26 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 89 below describes the starting and ending position of this segment on each transcript.

TABLE 89

Segment location on transcripts

| Transcript name | Segment starting position | Segment ending position |
|---|---|---|
| Z21368_PEA_1_T10 (SEQ ID NO: 9) | 631 | 807 |
| Z21368_PEA_1_T11 (SEQ ID NO: 10) | 631 | 807 |
| Z21368_PEA_1_T23 (SEQ ID NO: 11) | 631 | 807 |
| Z21368_PEA_1_T24 (SEQ ID NO: 12) | 631 | 807 |
| Z21368_PEA_1_T5 (SEQ ID NO: 13) | 469 | 645 |
| Z21368_PEA_1_T6 (SEQ ID NO: 14) | 469 | 645 |
| Z21368_PEA_1_T9 (SEQ ID NO: 15) | 496 | 672 |

Segment cluster Z21368_PEA_1_node_19 (SEQ ID NO:1069) according to the present invention is supported by 24 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), and Z21368_PEA_1_T6 (SEQ ID NO:14). Table 90 below describes the starting and ending position of this segment on each transcript.

TABLE 90

Segment location on transcripts

| Transcript name | Segment starting position | Segment ending position |
|---|---|---|
| Z21368_PEA_1_T10 (SEQ ID NO: 9) | 863 | 1102 |
| Z21368_PEA_1_T11 (SEQ ID NO: 10) | 863 | 1102 |
| Z21368_PEA_1_T23 (SEQ ID NO: 11) | 863 | 1102 |
| Z21368_PEA_1_T24 (SEQ ID NO: 12) | 863 | 1102 |
| Z21368_PEA_1_T5 (SEQ ID NO: 13) | 701 | 940 |
| Z21368_PEA_1_T6 (SEQ ID NO: 14) | 701 | 940 |

Segment cluster Z21368_PEA_1_node_2 (SEQ ID NO:1070) according to the present invention is supported by 15 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13) and Z21368_PEA_1_T6 (SEQ ID NO:14). Table 91 below describes the starting and ending position of this segment on each transcript.

TABLE 91

Segment location on transcripts

| Transcript name | Segment starting position | Segment ending position |
|---|---|---|
| Z21368_PEA_1_T10 (SEQ ID NO: 9) | 1 | 300 |
| Z21368_PEA_1_T11 (SEQ ID NO: 10) | 1 | 300 |
| Z21368_PEA_1_T23 (SEQ ID NO: 11) | 1 | 300 |
| Z21368_PEA_1_T24 (SEQ ID NO: 12) | 1 | 300 |
| Z21368_PEA_1_T5 (SEQ ID NO: 13) | 1 | 300 |
| Z21368_PEA_1_T6 (SEQ ID NO: 14) | 1 | 300 |

Segment cluster Z21368_PEA_1_node_21 (SEQ ID NO:1071) according to the present invention is supported by 37 libraries. The number of libraries was determined as previously described. This segment can be found in the following transcript(s): Z21368_PEA_1_T10 (SEQ ID NO:9), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 92 below describes the starting and ending position of this segment on each transcript.

TABLE 92

Segment location on transcripts

| Transcript name | Segment starting position | Segment ending position |
|---|---|---|
| Z21368_PEA_1_T10 (SEQ ID NO: 9) | 1103 | 1254 |

TABLE 92-continued

Segment location on transcripts

| Transcript name | Segment starting position | Segment ending position |
|---|---|---|
| Z21368_PEA_1_T23 (SEQ ID NO: 11) | 1103 | 1254 |
| Z21368_PEA_1_T24 (SEQ ID NO: 12) | 1103 | 1254 |
| Z21368_PEA_1_T5 (SEQ ID NO: 13) | 941 | 1092 |
| Z21368_PEA_1_T6 (SEQ ID NO: 14) | 941 | 1092 |
| Z21368_PEA_1_T9 (SEQ ID NO: 15) | 728 | 879 |

Segment cluster Z21368_PEA_1_node_33 (SEQ ID NO:1072) according to the present invention is supported by 45 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 93 below describes the starting and ending position of this segment on each transcript.

TABLE 93

Segment location on transcripts

| Transcript name | Segment starting position | Segment ending position |
|---|---|---|
| Z21368_PEA_1_T10 (SEQ ID NO: 9) | 1502 | 1677 |
| Z21368_PEA_1_T11 (SEQ ID NO: 10) | 1424 | 1599 |
| Z21368_PEA_1_T23 (SEQ ID NO: 11) | 1576 | 1751 |
| Z21368_PEA_1_T24 (SEQ ID NO: 12) | 1576 | 1751 |
| Z21368_PEA_1_T5 (SEQ ID NO: 13) | 1414 | 1589 |
| Z21368_PEA_1_T6 (SEQ ID NO: 14) | 1414 | 1589 |
| Z21368_PEA_1_T9 (SEQ ID NO: 15) | 1201 | 1376 |

Segment cluster Z21368_PEA_1_node_36 (SEQ ID NO:1073) according to the present invention is supported by 44 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 94 below describes the starting and ending position of this segment on each transcript.

TABLE 94

Segment location on transcripts

| Transcript name | Segment starting position | Segment ending position |
|---|---|---|
| Z21368_PEA_1_T10 (SEQ ID NO: 9) | 1678 | 1806 |

TABLE 94-continued

Segment location on transcripts

| Transcript name | Segment starting position | Segment ending position |
|---|---|---|
| Z21368_PEA_1_T11 (SEQ ID NO: 10) | 1600 | 1728 |
| Z21368_PEA_1_T23 (SEQ ID NO: 11) | 1752 | 1880 |
| Z21368_PEA_1_T24 (SEQ ID NO: 12) | 1752 | 1880 |
| Z21368_PEA_1_T5 (SEQ ID NO: 13) | 1590 | 1718 |
| Z21368_PEA_1_T6 (SEQ ID NO: 14) | 1590 | 1718 |
| Z21368_PEA_1_T9 (SEQ ID NO: 15) | 1377 | 1505 |

Segment cluster Z21368_PEA_1_node_37 (SEQ ID NO:1074) according to the present invention is supported by 3 libraries. The number of libraries was determined as previously described. This segment can be found in the following transcript(s): Z21368_PEA_1_T24 (SEQ ID NO:12). Table 95 below describes the starting and ending position of this segment on each transcript.

TABLE 95

Segment location on transcripts

| Transcript name | Segment starting position | Segment ending position |
|---|---|---|
| Z21368_PEA_1_T24 (SEQ ID NO: 12) | 1881 | 2159 |

Segment cluster Z21368_PEA_1_node_39 (SEQ ID NO:1075) according to the present invention is supported by 5 libraries. The number of libraries was determined as previously described. This segment can be found in the following transcript(s): Z21368_PEA_1_T23 (SEQ ID NO:11) and Z21368_PEA_1_T24 (SEQ ID NO:12). Table 96 below describes the starting and ending position of this segment on each transcript.

TABLE 96

Segment location on transcripts

| Transcript name | Segment starting position | Segment ending position |
|---|---|---|
| Z21368_PEA_1_T23 (SEQ ID NO: 11) | 1938 | 2790 |
| Z21368_PEA_1_T24 (SEQ ID NO: 12) | 2217 | 3069 |

Segment cluster Z21368_PEA_1_node_4 (SEQ ID NO:1076) according to the present invention is supported by 13 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11) and Z21368_PEA_1_T24 (SEQ ID NO:12). Table 97 below describes the starting and ending position of this segment on each transcript.

TABLE 97

Segment location on transcripts

| Transcript name | Segment starting position | Segment ending position |
| --- | --- | --- |
| Z21368_PEA_1_T10 (SEQ ID NO: 9) | 301 | 462 |
| Z21368_PEA_1_T11 (SEQ ID NO: 10) | 301 | 462 |
| Z21368_PEA_1_T23 (SEQ ID NO: 11) | 301 | 462 |
| Z21368_PEA_1_T24 (SEQ ID NO: 12) | 301 | 462 |

Segment cluster Z21368_PEA_1_node_41 (SEQ ID NO:1077) according to the present invention is supported by 49 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 98 below describes the starting and ending position of this segment on each transcript.

TABLE 98

Segment location on transcripts

| Transcript name | Segment starting position | Segment ending position |
| --- | --- | --- |
| Z21368_PEA_1_T10 (SEQ ID NO: 9) | 1864 | 1993 |
| Z21368_PEA_1_T11 (SEQ ID NO: 10) | 1786 | 1915 |
| Z21368_PEA_1_T5 (SEQ ID NO: 13) | 1776 | 1905 |
| Z21368_PEA_1_T6 (SEQ ID NO: 14) | 1776 | 1905 |
| Z21368_PEA_1_T9 (SEQ ID NO: 15) | 1563 | 1692 |

Segment cluster Z21368_PEA_1_node_43 (SEQ ID NO:1078) according to the present invention is supported by 52 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 99 below describes the starting and ending position of this segment on each transcript.

TABLE 99

Segment location on transcripts

| Transcript name | Segment starting position | Segment ending position |
| --- | --- | --- |
| Z21368_PEA_1_T10 (SEQ ID NO: 9) | 1994 | 2210 |
| Z21368_PEA_1_T11 (SEQ ID NO: 10) | 1916 | 2132 |
| Z21368_PEA_1_T5 (SEQ ID NO: 13) | 1906 | 2122 |
| Z21368_PEA_1_T6 (SEQ ID NO: 14) | 1906 | 2122 |
| Z21368_PEA_1_T9 (SEQ ID NO: 15) | 1693 | 1909 |

Segment cluster Z21368_PEA_1_node_45 (SEQ ID NO:1079) according to the present invention is supported by 64 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 100 below describes the starting and ending position of this segment on each transcript.

TABLE 100

Segment location on transcripts

| Transcript name | Segment starting position | Segment ending position |
| --- | --- | --- |
| Z21368_PEA_1_T10 (SEQ ID NO: 9) | 2211 | 2466 |
| Z21368_PEA_1_T11 (SEQ ID NO: 10) | 2133 | 2388 |
| Z21368_PEA_1_T5 (SEQ ID NO: 13) | 2123 | 2378 |
| Z21368_PEA_1_T6 (SEQ ID NO: 14) | 2123 | 2378 |
| Z21368_PEA_1_T9 (SEQ ID NO: 15) | 1910 | 2165 |

Segment cluster Z21368_PEA_1_node_53 (SEQ ID NO:1080) according to the present invention is supported by 60 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 101 below describes the starting and ending position of this segment on each transcript.

TABLE 102

Segment location on transcripts

| Transcript name | Segment starting position | Segment ending position |
| --- | --- | --- |
| Z21368_PEA_1_T10 (SEQ ID NO:9) | 2725 | 2900 |
| Z21368_PEA_1_T11 (SEQ ID NO:10) | 2647 | 2822 |
| Z21368_PEA_1_T5 (SEQ ID NO:13) | 2637 | 2812 |
| Z21368_PEA_1_T6 (SEQ ID NO:14) | 2637 | 2812 |
| Z21368_PEA_1_T9 (SEQ ID NO:15) | 2424 | 2599 |

Segment cluster Z21368_PEA_1_node_56 (SEQ ID NO:1081) according to the present invention is supported by 50 libraries. The number of libraries was determined as previously described. This segment can be found in the following transcript(s): Z21368_PEA_1_T10 (SEQ ID NO:9), Z21368_PEA_1_T11 (SEQ ID NO:10) and Z21368_PEA_1_T9 (SEQ ID NO:15). Table 102 below describes the starting and ending position of this segment on each transcript.

TABLE 102

Segment location on transcripts

| Transcript name | Segment starting position | Segment ending position |
|---|---|---|
| Z21368_PEA_1_T10 (SEQ ID NO:9) | 2901 | 3043 |
| Z21368_PEA_1_T11 (SEQ ID NO:10) | 2823 | 2965 |
| Z21368_PEA_1_T9 (SEQ ID NO:15) | 2600 | 2742 |

Segment cluster Z21368_PEA_1_node_58 (SEQ ID NO:1082) according to the present invention is supported by 71 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368 PEA_1_T9 (SEQ ID NO:15). Table 103 below describes the starting and ending position of this segment on each transcript.

TABLE 103

Segment location on transcripts

| Transcript name | Segment starting position | Segment ending position |
|---|---|---|
| Z21368_PEA_1_T10 (SEQ ID NO:9) | 3044 | 3167 |
| Z21368_PEA_1_T11 (SEQ ID NO:10) | 2966 | 3089 |
| Z21368_PEA_1_T5 (SEQ ID NO:13) | 2813 | 2936 |
| Z21368_PEA_1_T6 (SEQ ID NO:14) | 2813 | 2936 |
| Z21368_PEA_1_T9 (SEQ ID NO:15) | 2743 | 2866 |

Segment cluster Z21368_PEA_1_node_66 (SEQ ID NO:1083) according to the present invention is supported by 142 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 104 below describes the starting and ending position of this segment on each transcript.

TABLE 104

Segment location on transcripts

| Transcript name | Segment starting position | Segment ending position |
|---|---|---|
| Z21368_PEA_1_T10 (SEQ ID NO:9) | 3202 | 3789 |
| Z21368_PEA_1_T11 (SEQ ID NO:10) | 3124 | 3711 |
| Z21368_PEA_1_T5 (SEQ ID NO:13) | 2971 | 3558 |
| Z21368_PEA_1_T6 (SEQ ID NO:14) | 2971 | 3558 |
| Z21368_PEA_1_T9 (SEQ ID NO:15) | 2901 | 3488 |

Segment cluster Z21368_PEA_1_node_67 (SEQ ID NO:1084) according to the present invention is supported by 181 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 105 below describes the starting and ending position of this segment on each transcript.

TABLE 105

Segment location on transcripts

| Transcript name | Segment starting position | Segment ending position |
|---|---|---|
| Z21368_PEA_1_T10 (SEQ ID NO: 9) | 3790 | 4374 |
| Z21368_PEA_1_T11 (SEQ ID NO: 10) | 3712 | 4296 |
| Z21368_PEA_1_T5 (SEQ ID NO: 13) | 3559 | 4143 |
| Z21368_PEA_1_T6 (SEQ ID NO: 14) | 3559 | 4143 |
| Z21368_PEA_1_T9 (SEQ ID NO: 15) | 3489 | 4073 |

Segment cluster Z21368_PEA_1_node_69 (SEQ ID NO:1085) according to the present invention is supported by 150 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 106 below describes the starting and ending position of this segment on each transcript.

TABLE 107

Segment location on transcripts

| Transcript name | Segment starting position | Segment ending position |
|---|---|---|
| Z21368_PEA_1_T10 (SEQ ID NO: 9) | 4428 | 4755 |
| Z21368_PEA_1_T11 (SEQ ID NO: 10) | 4350 | 4677 |
| Z21368_PEA_1_T5 (SEQ ID NO: 13) | 4197 | 5384 |
| Z21368_PEA_1_T6 (SEQ ID NO: 14) | 4197 | 4524 |
| Z21368_PEA_1_T9 (SEQ ID NO: 15) | 4127 | 4454 |

According to an optional embodiment of the present invention, short segments related to the above cluster are also provided. These segments are up to about 120 bp in length, and so are included in a separate description.

Segment cluster Z21368_PEA_1_node_11 (SEQ ID NO:1086) according to the present invention is supported by 26 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_

1_T9 (SEQ ID NO:15). Table 107 below describes the starting and ending position of this segment on each transcript.

TABLE 107

Segment location on transcripts

| Transcript name | Segment starting position | Segment ending position |
| --- | --- | --- |
| Z21368_PEA_1_T10 (SEQ ID NO: 9) | 558 | 602 |
| Z21368_PEA_1_T11 (SEQ ID NO: 10) | 558 | 602 |
| Z21368_PEA_1_T23 (SEQ ID NO: 11) | 558 | 602 |
| Z21368_PEA_1_T24 (SEQ ID NO: 12) | 558 | 602 |
| Z21368_PEA_1_T5 (SEQ ID NO: 13) | 396 | 440 |
| Z21368_PEA_1_T6 (SEQ ID NO: 14) | 396 | 440 |
| Z21368_PEA_1_T9 (SEQ ID NO: 15) | 423 | 467 |

Segment cluster Z21368_PEA_1_node_12 (SEQ ID NO:1087) according to the present invention is supported by 23 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 108 below describes the starting and ending position of this segment on each transcript.

TABLE 108

Segment location on transcripts

| Transcript name | Segment starting position | Segment ending position |
| --- | --- | --- |
| Z21368_PEA_1_T10 (SEQ ID NO: 9) | 603 | 630 |
| Z21368_PEA_1_T11 (SEQ ID NO: 10) | 603 | 630 |
| Z21368_PEA_1_T23 (SEQ ID NO: 11) | 603 | 630 |
| Z21368_PEA_1_T24 (SEQ ID NO: 12) | 603 | 630 |
| Z21368_PEA_1_T5 (SEQ ID NO: 13) | 441 | 468 |
| Z21368_PEA_1_T6 (SEQ ID NO: 14) | 441 | 468 |
| Z21368_PEA_1_T9 (SEQ ID NO: 15) | 468 | 495 |

Segment cluster Z21368_PEA_1_node_16 (SEQ ID NO:1088) according to the present invention can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 109 below describes the starting and ending position of this segment on each transcript.

TABLE 109

Segment location on transcripts

| Transcript name | Segment starting position | Segment ending position |
| --- | --- | --- |
| Z21368_PEA_1_T10 (SEQ ID NO: 9) | 808 | 822 |
| Z21368_PEA_1_T11 (SEQ ID NO: 10) | 808 | 822 |
| Z21368_PEA_1_T23 (SEQ ID NO: 11) | 808 | 822 |
| Z21368_PEA_1_T24 (SEQ ID NO: 12) | 808 | 822 |
| Z21368_PEA_1_T5 (SEQ ID NO: 13) | 646 | 660 |
| Z21368_PEA_1_T6 (SEQ ID NO: 14) | 646 | 660 |
| Z21368_PEA_1_T9 (SEQ ID NO: 15) | 673 | 687 |

Segment cluster Z21368_PEA_1_node_17 (SEQ ID NO:1089) according to the present invention is supported by 19 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 110 below describes the starting and ending position of this segment on each transcript.

TABLE 110

Segment location on transcripts

| Transcript name | Segment starting position | Segment ending position |
| --- | --- | --- |
| Z21368_PEA_1_T10 (SEQ ID NO: 9) | 823 | 862 |
| Z21368_PEA_1_T11 (SEQ ID NO: 10) | 823 | 862 |
| Z21368_PEA_1_T23 (SEQ ID NO: 11) | 823 | 862 |
| Z21368_PEA_1_T24 (SEQ ID NO: 12) | 823 | 862 |
| Z21368_PEA_1_T5 (SEQ ID NO: 13) | 661 | 700 |
| Z21368_PEA_1_T6 (SEQ ID NO: 14) | 661 | 700 |
| Z21368_PEA_1_T9 (SEQ ID NO: 15) | 688 | 727 |

Segment cluster Z21368_PEA_1_node_23 (SEQ ID NO:1090) according to the present invention is supported by 36 libraries. The number of libraries was determined as previously described. This segment can be found in the following transcript(s): Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 111 below describes the starting and ending position of this segment on each transcript.

TABLE 111

Segment location on transcripts

| Transcript name | Segment starting position | Segment ending position |
|---|---|---|
| Z21368_PEA_1_T11 (SEQ ID NO: 10) | 1103 | 1176 |
| Z21368_PEA_1_T23 (SEQ ID NO: 11) | 1255 | 1328 |
| Z21368_PEA_1_T24 (SEQ ID NO: 12) | 1255 | 1328 |
| Z21368_PEA_1_T5 (SEQ ID NO: 13) | 1093 | 1166 |
| Z21368_PEA_1_T6 (SEQ ID NO: 14) | 1093 | 1166 |
| Z21368_PEA_1_T9 (SEQ ID NO: 15) | 880 | 953 |

Segment cluster Z21368_PEA_1_node_24 (SEQ ID NO:1091) according to the present invention is supported by 36 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 112 below describes the starting and ending position of this segment on each transcript.

TABLE 112

Segment location on transcripts

| Transcript name | Segment starting position | Segment ending position |
|---|---|---|
| Z21368_PEA_1_T10 (SEQ ID NO: 9) | 1255 | 1350 |
| Z21368_PEA_1_T11 (SEQ ID NO: 10) | 1177 | 1272 |
| Z21368_PEA_1_T23 (SEQ ID NO: 11) | 1329 | 1424 |
| Z21368_PEA_1_T24 (SEQ ID NO: 12) | 1329 | 1424 |
| Z21368_PEA_1_T5 (SEQ ID NO: 13) | 1167 | 1262 |
| Z21368_PEA_1_T6 (SEQ ID NO: 14) | 1167 | 1262 |
| Z21368_PEA_1_T9 (SEQ ID NO: 15) | 954 | 1049 |

Segment cluster Z21368_PEA_1_node_30 (SEQ ID NO:1092) according to the present invention is supported by 39 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 113 below describes the starting and ending position of this segment on each transcript.

TABLE 113

Segment location on transcripts

| Transcript name | Segment starting position | Segment ending position |
|---|---|---|
| Z21368_PEA_1_T10 (SEQ ID NO: 9) | 1351 | 1409 |
| Z21368_PEA_1_T11 (SEQ ID NO: 10) | 1273 | 1331 |
| Z21368_PEA_1_T23 (SEQ ID NO: 11) | 1425 | 1483 |
| Z21368_PEA_1_T24 (SEQ ID NO: 12) | 1425 | 1483 |
| Z21368_PEA_1_T5 (SEQ ID NO: 13) | 1263 | 1321 |
| Z21368_PEA_1_T6 (SEQ ID NO: 14) | 1263 | 1321 |
| Z21368_PEA_1_T9 (SEQ ID NO: 15) | 1050 | 1108 |

Segment cluster Z21368_PEA_1_node_31 (SEQ ID NO:1093) according to the present invention is supported by 40 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 114 below describes the starting and ending position of this segment on each transcript.

TABLE 114

Segment location on transcripts

| Transcript name | Segment starting position | Segment ending position |
|---|---|---|
| Z21368_PEA_1_T10 (SEQ ID NO: 9) | 1410 | 1501 |
| Z21368_PEA_1_T11 (SEQ ID NO: 10) | 1332 | 1423 |
| Z21368_PEA_1_T23 (SEQ ID NO: 11) | 1484 | 1575 |
| Z21368_PEA_1_T24 (SEQ ID NO: 12) | 1484 | 1575 |
| Z21368_PEA_1_T5 (SEQ ID NO: 13) | 1322 | 1413 |
| Z21368_PEA_1_T6 (SEQ ID NO: 14) | 1322 | 1413 |
| Z21368_PEA_1_T9 (SEQ ID NO: 15) | 1109 | 1200 |

Segment cluster Z21368_PEA_1_node_38 (SEQ ID NO:1094) according to the present invention is supported by 45 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 115 below describes the starting and ending position of this segment on each transcript.

TABLE 115

Segment location on transcripts

| Transcript name | Segment starting position | Segment ending position |
|---|---|---|
| Z21368_PEA_1_T10 (SEQ ID NO: 9) | 1807 | 1863 |
| Z21368_PEA_1_T11 (SEQ ID NO: 10) | 1729 | 1785 |
| Z21368_PEA_1_T23 (SEQ ID NO: 11) | 1881 | 1937 |
| Z21368_PEA_1_T24 (SEQ ID NO: 12) | 2160 | 2216 |
| Z21368_PEA_1_T5 (SEQ ID NO: 13) | 1719 | 1775 |
| Z21368_PEA_1_T6 (SEQ ID NO: 14) | 1719 | 1775 |
| Z21368_PEA_1_T9 (SEQ ID NO: 15) | 1506 | 1562 |

Segment cluster Z21368_PEA_1_node_47 (SEQ ID NO:1095) according to the present invention is supported by 61 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 116 below describes the starting and ending position of this segment on each transcript.

TABLE 116

Segment location on transcripts

| Transcript name | Segment starting position | Segment ending position |
|---|---|---|
| Z21368_PEA_1_T10 (SEQ ID NO: 9) | 2467 | 2563 |
| Z21368_PEA_1_T11 (SEQ ID NO: 10) | 2389 | 2485 |
| Z21368_PEA_1_T5 (SEQ ID NO: 13) | 2379 | 2475 |
| Z21368_PEA_1_T6 (SEQ ID NO: 14) | 2379 | 2475 |
| Z21368_PEA_1_T9 (SEQ ID NO: 15) | 2166 | 2262 |

Segment cluster Z21368_PEA_1_node_49 (SEQ ID NO:1096) according to the present invention is supported by 57 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 117 below describes the starting and ending position of this segment on each transcript.

TABLE 117

Segment location on transcripts

| Transcript name | Segment starting position | Segment ending position |
|---|---|---|
| Z21368_PEA_1_T10 (SEQ ID NO: 9) | 2564 | 2658 |
| Z21368_PEA_1_T11 (SEQ ID NO: 10) | 2486 | 2580 |

TABLE 117-continued

Segment location on transcripts

| Transcript name | Segment starting position | Segment ending position |
|---|---|---|
| Z21368_PEA_1_T5 (SEQ ID NO: 13) | 2476 | 2570 |
| Z21368_PEA_1_T6 (SEQ ID NO: 14) | 2476 | 2570 |
| Z21368_PEA_1_T9 (SEQ ID NO: 15) | 2263 | 2357 |

Segment cluster Z21368_PEA_1_node_51 (SEQ ID NO:1097) according to the present invention is supported by 46 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 118 below describes the starting and ending position of this segment on each transcript.

TABLE 118

Segment location on transcripts

| Transcript name | Segment starting position | Segment ending position |
|---|---|---|
| Z21368_PEA_1_T10 (SEQ ID NO: 9) | 2659 | 2724 |
| Z21368_PEA_1_T11 (SEQ ID NO: 10) | 2581 | 2646 |
| Z21368_PEA_1_T5 (SEQ ID NO: 13) | 2571 | 2636 |
| Z21368_PEA_1_T6 (SEQ ID NO: 14) | 2571 | 2636 |
| Z21368_PEA_1_T9 (SEQ ID NO: 15) | 2358 | 2423 |

Segment cluster Z21368_PEA_1_node_61 (SEQ ID NO:1098) according to the present invention is supported by 61 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 119 below describes the starting and ending position of this segment on each transcript.

TABLE 119

Segment location on transcripts

| Transcript name | Segment starting position | Segment ending position |
|---|---|---|
| Z21368_PEA_1_T10 (SEQ ID NO: 9) | 3168 | 3201 |
| Z21368_PEA_1_T11 (SEQ ID NO: 10) | 3090 | 3123 |
| Z21368_PEA_1_T5 (SEQ ID NO: 13) | 2937 | 2970 |
| Z21368_PEA_1_T6 (SEQ ID NO: 14) | 2937 | 2970 |
| Z21368_PEA_1_T9 (SEQ ID NO: 15) | 2867 | 2900 |

Segment cluster Z21368_PEA_1_node_68 (SEQ ID NO:1099) according to the present invention is supported by 87 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 120 below describes the starting and ending position of this segment on each transcript.

TABLE 120

Segment location on transcripts

| Transcript name | Segment starting position | Segment ending position |
| --- | --- | --- |
| Z21368_PEA_1_T10 (SEQ ID NO: 9) | 4375 | 4427 |
| Z21368_PEA_1_T11 (SEQ ID NO: 10) | 4297 | 4349 |
| Z21368_PEA_1_T5 (SEQ ID NO: 13) | 4144 | 4196 |
| Z21368_PEA_1_T6 (SEQ ID NO: 14) | 4144 | 4196 |
| Z21368_PEA_1_T9 (SEQ ID NO: 15) | 4074 | 4126 |

Segment cluster Z21368_PEA_1_node_7 (SEQ ID NO:1100) according to the present invention is supported by 29 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 121 below describes the starting and ending position of this segment on each transcript.

TABLE 121

Segment location on transcripts

| Transcript name | Segment starting position | Segment ending position |
| --- | --- | --- |
| Z21368_PEA_1_T10 (SEQ ID NO: 9) | 463 | 557 |
| Z21368_PEA_1_T11 (SEQ ID NO: 10) | 463 | 557 |
| Z21368_PEA_1_T23 (SEQ ID NO: 11) | 463 | 557 |
| Z21368_PEA_1_T24 (SEQ ID NO: 12) | 463 | 557 |
| Z21368_PEA_1_T5 (SEQ ID NO: 13) | 301 | 395 |
| Z21368_PEA_1_T6 (SEQ ID NO: 14) | 301 | 395 |
| Z21368_PEA_1_T9 (SEQ ID NO: 15) | 328 | 422 |

Overexpression of at least a portion of this cluster was determined according to oligonucleotides and one or more chips. The results were as follows: Oligonucleotide Z21368_0_0_61857 was on the TAA chip and was found to be overexpressed in Lung cancer (general), in Lung adenocarcinoma, and in Lung squamous cell cancer.

Variant Protein Alignment to the Previously Known Protein:
Sequence name: /tmp/5ER3vIMKE2/9LOY71DlTQ: SUL1_HUMAN (SEQ ID NO:1419)
Sequence documentation:
Alignment of: Z21368_PEA_1_P2 (SEQ ID NO:1289) x SUL1_HUMAN (SEQ ID NO:1419) ..
Alignment segment 1/1:

| Quality: | 7664.00 | Escore: | 0 |
| --- | --- | --- | --- |
| Matching length: | 761 | Total length: | 761 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKYSCCALVLAVLGTELLGSLCSTVRSPRFRGRIQQERKNIRPNIILVLT   50
    |||||||||||||||||||||||||||||||||||||||||||||||||
  1 MKYSCCALVLAVLGTELLGSLCSTVRSPRFRGRIQQERKNIRPNIILVLT   50

51 DDQDVELGSLQVMNKTRKIMEHGGATFINAFVTTPMCCPSRSSMLTGKYV  100
    |||||||||||||||||||||||||||||||||||||||||||||||||
 51 DDQDVELGSLQVMNKTRKIMEHGGATFINAFVTTPMCCPSRSSMLTGKYV  100

101 HNHNVYTNNENCSSPSWQAMHEPRTFAVYLNNTGYRTAFFGKYLNEYNGS  150
    |||||||||||||||||||||||||||||||||||||||||||||||||
101 HNHNVYTNNENCSSPSWQAMHEPRTFAVYLNNTGYRTAFFGKYLNEYNGS  150

151 YIPPGWREWLGLIKNSRFYNYTVCRNGIKEKHGFDYAKDYFTDLITNESI  200
    |||||||||||||||||||||||||||||||||||||||||||||||||
151 YIPPGWREWLGLIKNSRFYNYTVCRNGIKEKHGFDYAKDYFTDLITNESI  200

201 NYFKMSKRMYPHRPVMMVISHAAPHGPEDSAPQFSKLYPNASQHITPSYN  250
    |||||||||||||||||||||||||||||||||||||||||||||||||
201 NYFKMSKRMYPHRPVMMVISHAAPHGPEDSAPQFSKLYPNASQHITPSYN  250

251 YAPNMDKHWIMQYTGPMLPIHMEFTNILQRKRLQTLMSVDDSVERLYNML  300
    |||||||||||||||||||||||||||||||||||||||||||||||||
251 YAPNMDKHWIMQYTGPMLPIHMEFTNILQRKRLQTLMSVDDSVERLYNML  300
```

-continued

```
301  VETGELENTYIIYTADHGYHIGQFGLVKGKSMPYDFDIRVPFFIRGPSVE  350
     ||||||||||||||||||||||||||||||||||||||||||||||||||
301  VETGELENTYIIYTADHGYHIGQFGLVKGKSMPYDFDIRVPFFIRGPSVE  350

351  PGSIVPQIVLNIDLAPTILDIAGLDTPPDVDGKSVLKLLDPEKPGNRFRT  400
     ||||||||||||||||||||||||||||||||||||||||||||||||||
351  PGSIVPQIVLNIDLAPTILDIAGLDTPPDVDGKSVLKLLDPEKPGNRFRT  400

401  NKKAKIWRDTFLVERGKFLRKKEESSKNIQQSNHLPKYERVKELCQQARY  450
     ||||||||||||||||||||||||||||||||||||||||||||||||||
401  NKKAKIWRDTFLVERGKFLRKKEESSKNIQQSNHLPKYERVKELCQQARY  450

451  QTACEQPGQKWQCIEDTSGKLRIHKCKGPSDLLTVRQSTRNLYARGFHDK  500
     ||||||||||||||||||||||||||||||||||||||||||||||||||
451  QTACEQPGQKWQCIEDTSGKLRIHKCKGPSDLLTVRQSTRNLYARGFHDK  500

501  DKECSCRESGTRASRSQRKSQRQFLRNQGTPKYKPRFVHTRQTRSLSVEF  550
     ||||||||||||||||||||||||||||||||||||||||||||||||||
501  DKECSCRESGTRASRSQRKSQRQFLRNQGTPKYKPRFVHTRQTRSLSVEF  550

551  EGEIYDINLEEEELQVLQPRNIAKRHDEGHKGPRDLQASSGGNRGRMLA   600
     ||||||||||||||||||||||||||||||||||||||||||||||||||
551  EGEIYDINLEEEELQVLQPRNIAKRHDEGHKGPRDLQASSGGNRGRMLA   600

601  DSSNAVGPPTTVRVTHKCFILPNDSIHCERELYQSARAWKDHKAYIDKEI  650
     ||||||||||||||||||||||||||||||||||||||||||||||||||
601  DSSNAVGPPTTVRVTHKCFILPNDSIHCERELYQSARAWKDHKAYIDKEI  650

651  EALQDKIKNLREVRGHLKRRKPEECSCSKQSYYNKEKGVKKQEKLKSHLH  700
     ||||||||||||||||||||||||||||||||||||||||||||||||||
651  EALQDKIKNLREVRGHLKRRKPEECSCSKQSYYNKEKGVKKQEKLKSHLH  700

701  PFKEAAQEVDSKLQLFKENNRRRKKERKEKRRQRKGEECSLPGLTCFTHD  750
     ||||||||||||||||||||||||||||||||||||||||||||||||||
701  PFKEAAQEVDSKLQLFKENNRRRKKERKEKRRQRKGEECSLPGLTCFTHD  750

751  NNHWQTAPFWN  761
     |||||||||||
751  NNHWQTAPFWN  761
```

Sequence name: /tmp/tt3yfXIUKV/YxSTFWr66h:Q7Z2W2 (SEQ ID NO:1697)
Sequence documentation:
Alignment of: Z21368_PEA__1_P5 (SEQ ID NO:1290) x Q7Z2W2 (SEQ ID NO:1697) ..
Alignment segment 1/1:

| Quality: | 7869.00 | Escore: | 0 |
|---|---|---|---|
| Matching length: | 791 | Total length: | 871 |

| | | | |
|---|---|---|---|
| Matching Percent Similarity: | 99.87 | Matching Percent Identity: | 99.87 |
| Total Percent Similarity: | 90.70 | Total Percent Identity: | 90.70 |
| Gaps: | 1 | | |

Alignment:

```
1    MKYSCCALVLAVLGTELLGSLCSTVRSPRFRGRIQQERKNIRPNIILVLT  50
     ||||||||||||||||||||||||||||||||||||||||||||||||||
1    MKYSCCALVLAVLGTELLGSLCSTVRSPRFRGRIQQERKNIRPNIILVLT  50

51   DDQDVELA..........................................  58
     ||||||||
51   DDQDVELGSLQVMNKTRKIMEHGGATFINAFVTTPMCCPSRSSMLTGKYV  100

59   ...................................FFGKYLNEYNGS    70
                                        |||||||||||||
101  HNHNVYTNNENCSSPSWQAMHEPRTFAVYLNNTGYRTAFFGKYLNEYNGS  150

71   YIPPGWREWLGLIKNSRFYNYTVCRNGIKEKHGFDYAKDYFTDLITNESI  120
     ||||||||||||||||||||||||||||||||||||||||||||||||||
151  YIPPGWREWLGLIKNSRFYNYTVCRNGIKEKHGFDYAKDYFTDLITNESI  200

121  NYFKMSKRMYPHRPVMMVISHAAPHGPEDSAPQFSKLYPNASQHITPSYN  170
     ||||||||||||||||||||||||||||||||||||||||||||||||||
201  NYFKMSKRMYPHRPVMMVISHAAPHGPEDSAPQFSKLYPNASQHITPSYN  250
```

```
171  YAPNMDKHWIMQYTGPMLPIHMEFTNILQRKRLQTLMSVDDSVERLYNML  220
     |||||||||||||||||||||||||||||||||||||||||||||||||
251  YAPNMDKHWIMQYTGPMLPIHMEFTNILQRKRLQTLMSVDDSVERLYNML  300

221  VETGELENTYIIYTADHGYHIGQFGLVKGKSMPYDFDIRVPFFIRGPSVE  270
     |||||||||||||||||||||||||||||||||||||||||||||||||
301  VETGELENTYIIYTADHGYHIGQFGLVKGKSMPYDFDIRVPFFIRGPSVE  350

271  PGSIVPQIVLNIDLAPTILDIAGLDTPPDVDGKSVLKLLDPEKPGNRFRT  320
     |||||||||||||||||||||||||||||||||||||||||||||||||
351  PGSIVPQIVLNIDLAPTILDIAGLDTPPDVDGKSVLKLLDPEKPGNRFRT  400

321  NKKAKIWRDTFLVERGKFLRKKEESSKNIQQSNHLPKYERVKELCQQARY  370
     |||||||||||||||||||||||||||||||||||||||||||||||||
401  NKKAKIWRDTFLVERGKFLRKKEESSKNIQQSNHLPKYERVKELCQQARY  450

371  QTACEQPGQKWQCIEDTSGKLRIHKCKGPSDLLTVRQSTRNLYARGFHDK  420
     |||||||||||||||||||||||||||||||||||||||||||||||||
451  QTACEQPGQKWQCIEDTSGKLRIHKCKGPSDLLTVRQSTRNLYARGFHDK  500

421  DKECSCRESGTRASRSQRKSQRQFLRNQGTPKYKPRFVHTRQTRSLSVEF  470
     |||||||||||||||||||||||||||||||||||||||||||||||||
501  DKECSCRESGTRASRSQRKSQRQFLRNQGTPKYKPRFVHTRQTRSLSVEF  550

471  EGEIYDINLEEEELQVLQPRNIAKRHDEGHKGPRDLQASSGGNRGRMLA  520
     ||||||||||||||||||||||||||||||||||||||||||||||||
551  EGEIYDINLEEEELQVLQPRNIAKRHDEGHKGPRDLQASSGGNRGRMLA  600

521  DSSNAVGPPTTVRVTHKCFILPNDSIHCERELYQSARAWKDHKAYIDKEI  570
     |||||||||||||||||||||||||||||||||||||||||||||||||
601  DSSNAVGPPTTVRVTHKCFILPNDSIHCERELYQSARAWKDHKAYIDKEI  650

571  EALQDKIKNLREVRGHLKRRKPEECSCSKQSYYNKEKGVKKQEKLKSHLH  620
     |||||||||||||||||||||||||||||||||||||||||||||||||
651  EALQDKIKNLREVRGHLKRRKPEECSCSKQSYYNKEKGVKKQEKLKSHLH  700

621  PFKEAAQEVDSKLQLFKENNRRRKKERKEKRRQRKGEECSLPGLTCFTHD  670
     |||||||||||||||||||||||||||||||||||||||||||||||||
701  PFKEAAQEVDSKLQLFKENNRRRKKERKEKRRQRKGEECSLPGLTCFTHD  750

671  NNHWQTAPFWNLGSFCACTSSNNNTYWCLRTVNETHNFLFCEFATGFLEY  720
     |||||||||||||||||||||||||||||||||||||||||||||||||
751  NNHWQTAPFWNLGSFCACTSSNNNTYWCLRTVNETHNFLFCEFATGFLEY  800

721  FDMNTDPYQLTNTVHTVERGILNQLHVQLMELRSCQGYKQCNPRPKNLDV  770
     |||||||||||||||||||||||||||||||||||||||||||||||||
801  FDMNTDPYQLTNTVHTVERGILNQLHVQLMELRSCQGYKQCNPRPKNLDV  850

771  GNKDGGSYDLHRGQLWDGWEG  791
     |||||||||||||||||||||
851  GNKDGGSYDLHRGQLWDGWEG  871
```

Sequence name: /tmp/tt3yfXIUKV/YxSTFWr66h: AAH12997 (SEQ ID NO:1698)

Sequence documentation:

Alignment of: Z21368_PEA_1_P5 (SEQ ID NO:1290) x AAH12997 (SEQ ID NO:1698) ..

Alignment segment 1/1:

| Quality: | 420.00 | Escore: | 0 |
|---|---|---|---|
| Matching length: | 40 | Total length: | 40 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
752 LRSCQGYKQCNPRPKNLDVGNKDGGSYDLHRGQLWDGWEG   791
    ||||||||||||||||||||||||||||||||||||||||
  1 LRSCQGYKQCNPRPKNLDVGNKDGGSYDLHRGQLWDGWEG    40
```

Sequence name: /tmp/tt3yfXIUKV/YxSTFWr66h: SUL1_HUMAN (SEQ ID NO:1419)

Sequence documentation:

Alignment of: Z21368_PEA_1_P5 (SEQ ID NO:1290) x SUL1_HUMAN (SEQ ID NO:1419) ..

Alignment segment 1/1:

| Quality: | 7878.00 | Escore: | 0 |
|---|---|---|---|
| Matching length: | 791 | Total length: | 871 |
| Matching Percent Similarity: | 100.00 | Matching Percent Identity: | 100.00 |
| Total Percent Similarity: | 90.82 | Total Percent Identity: | 90.82 |
| Gaps: | 1 | | |

Alignment:

```
  1 MKYSCCALVLAVLGTELLGSLCSTVRSPRFRGRIQQERKNIRPNIILVLT    50
    |||||||||||||||||||||||||||||||||||||||||||||||||
  1 MKYSCCALVLAVLGTELLGSLCSTVRSPRFRGRIQQERKNIRPNIILVLT    50

51 DDQDVEL...........................................   57
    |||||||
 51 DDQDVELGSLQVMNKTRKIMEHGGATFINAFVTTPMCCPSRSSMLTGKYV   100

58 .................................AFFGKYLNEYNGS      70
                                     ||||||||||||||
101 HNHNVYTNNENCSSPSWQAMHEPRTFAVYLNNTGYRTAFFGKYLNEYNGS   150

71 YIPPGWREWLGLIKNSRFYNYTVCRNGIKEKHGFDYAKDYFTDLITNESI   120
    |||||||||||||||||||||||||||||||||||||||||||||||||
151 YIPPGWREWLGLIKNSRFYNYTVCRNGIKEKHGFDYAKDYFTDLITNESI   200

121 NYFKMSKRMYPHRPVMMVISHAAPHGPEDSAPQFSKLYPNASQHITPSYN   170
    |||||||||||||||||||||||||||||||||||||||||||||||||
201 NYFKMSKRMYPHRPVMMVISHAAPHGPEDSAPQFSKLYPNASQHITPSYN   250

171 YAPNMDKHWIMQYTGPMLPIHMEFTNILQRKRLQTLMSVDDSVERLYNML   220
    |||||||||||||||||||||||||||||||||||||||||||||||||
251 YAPNMDKHWIMQYTGPMLPIHMEFTNILQRKRLQTLMSVDDSVERLYNML   300

221 VETGELENTYIIYTADHGYHIGQFGLVKGKSMPYDFDIRVPFFIRGPSVE   270
    |||||||||||||||||||||||||||||||||||||||||||||||||
301 VETGELENTYIIYTADHGYHIGQFGLVKGKSMPYDFDIRVPFFIRGPSVE   350

271 PGSIVPQIVLNIDLAPTILDIAGLDTPPDVDGKSVLKLLDPEKPGNRFRT   320
    |||||||||||||||||||||||||||||||||||||||||||||||||
351 PGSIVPQIVLNIDLAPTILDIAGLDTPPDVDGKSVLKLLDPEKPGNRFRT   400

321 NKKAKIWRDTFLVERGKFLRKKEESSKNIQQSNHLPKYERVKELCQQARY   370
    |||||||||||||||||||||||||||||||||||||||||||||||||
401 NKKAKIWRDTFLVERGKFLRKKEESSKNIQQSNHLPKYERVKELCQQARY   450

371 QTACEQPGQKWQCIEDTSGKLRIHKCKGPSDLLTVRQSTRNLYARGFHDK   420
    |||||||||||||||||||||||||||||||||||||||||||||||||
451 QTACEQPGQKWQCIEDTSGKLRIHKCKGPSDLLTVRQSTRNLYARGFHDK   500
```

-continued

```
421  DKECSCRESGTRASRSQRKSQRQFLRNQGTPKYKPRFVHTRQTRSLSVEF   470
     ||||||||||||||||||||||||||||||||||||||||||||||||||
501  DKECSCRESGTRASRSQRKSQRQFLRNQGTPKYKPRFVHTRQTRSLSVEF   550

471  EGEIYDINLEEEEELQVLQPRNIAKRHDEGHKGPRDLQASSGGNRGRMLA   520
     ||||||||||||||||||||||||||||||||||||||||||||||||||
551  EGEIYDINLEEEEELQVLQPRNIAKRHDEGHKGPRDLQASSGGNRGRMLA   600

521  DSSNAVGPPTTVRVTHKCFILPNDSIHCERELYQSARAWKDHKAYIDKEI   570
     ||||||||||||||||||||||||||||||||||||||||||||||||||
601  DSSNAVGPPTTVRVTHKCFILPNDSIHCERELYQSARAWKDHKAYIDKEI   650

571  EALQDKIKNLREVRGHLKRRKPEECSCSKQSYYNKEKGVKKQEKLKSHLH   620
     ||||||||||||||||||||||||||||||||||||||||||||||||||
651  EALQDKIKNLREVRGHLKRRKPEECSCSKQSYYNKEKGVKKQEKLKSHLH   700

621  PFKEAAQEVDSKLQLFKENNRRRKKERKEKRRQRKGEECSLPGLTCFTHD   670
     ||||||||||||||||||||||||||||||||||||||||||||||||||
701  PFKEAAQEVDSKLQLFKENNRRRKKERKEKRRQRKGEECSLPGLTCFTHD   750

671  NNHWQTAPFWNLGSFCACTSSNNNTYWCLRTVNETHNFLFCEFATGFLEY   720
     ||||||||||||||||||||||||||||||||||||||||||||||||||
751  NNHWQTAPFWNLGSFCACTSSNNNTYWCLRTVNETHNFLFCEFATGFLEY   800

721  FDMNTDPYQLTNTVHTVERGILNQLHVQLMELRSCQGYKQCNPRPKNLDV   770
     ||||||||||||||||||||||||||||||||||||||||||||||||||
801  FDMNTDPYQLTNTVHTVERGILNQLHVQLMELRSCQGYKQCNPRPKNLDV   850

771  GNKDGGSYDLHRGQLWDGWEG                               791
     |||||||||||||||||||||
851  GNKDGGSYDLHRGQLWDGWEG                               871
```

Sequence name: /tmp/AVAZGWHuF0/RzHFOnHIsT: SUL1_HUMAN (SEQ ID NO:1419)

Sequence documentation:

Alignment of: Z21368_PEA_1_P15 (SEQ ID NO:1291) x SUL1_HUMAN (SEQ ID NO:1419) ..

Alignment segment 1/1:

| | | | |
|---|---|---|---|
| Quality: | 4174.00 | Escore: | 0 |
| Matching length: | 416 | Total length: | 416 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MKYSCCALVLAVLGTELLGSLCSTVRSPRFRGRIQQERKNIRPNIILVLT   50
     ||||||||||||||||||||||||||||||||||||||||||||||||||
  1  MKYSCCALVLAVLGTELLGSLCSTVRSPRFRGRIQQERKNIRPNIILVLT   50

51  DDQDVELGSLQVMNKTRKIMEHGGATFINAFVTTPMCCPSRSSMLTGKYV  100
     ||||||||||||||||||||||||||||||||||||||||||||||||||
 51  DDQDVELGSLQVMNKTRKIMEHGGATFINAFVTTPMCCPSRSSMLTGKYV  100

101  HNHNVYTNNENCSSPSWQAMHEPRTFAVYLNNTGYRTAFFGKYLNEYNGS  150
     ||||||||||||||||||||||||||||||||||||||||||||||||||
101  HNHNVYTNNENCSSPSWQAMHEPRTFAVYLNNTGYRTAFFGKYLNEYNGS  150

151  YIPPGWREWLGLIKNSRFYNYTVCRNGIKEKHGFDYAKDYFTDLITNESI  200
     ||||||||||||||||||||||||||||||||||||||||||||||||||
151  YIPPGWREWLGLIKNSRFYNYTVCRNGIKEKHGFDYAKDYFTDLITNESI  200

201  NYFKMSKRMYPHRPVMMVISHAAPHGPEDSAPQFSKLYPNASQHITPSYN  250
     ||||||||||||||||||||||||||||||||||||||||||||||||||
201  NYFKMSKRMYPHRPVMMVISHAAPHGPEDSAPQFSKLYPNASQHITPSYN  250
```

-continued

```
251  YAPNMDKHWIMQYTGPMLPIHMEFTNILQRKRLQTLMSVDDSVERLYNML   300
     |||||||||||||||||||||||||||||||||||||||||||||||||
251  YAPNMDKHWIMQYTGPMLPIHMEFTNILQRKRLQTLMSVDDSVERLYNML   300

301  VETGELENTYIIYTADHGYHIGQFGLVKGKSMPYDFDIRVPFFIRGPSVE   350
     |||||||||||||||||||||||||||||||||||||||||||||||||
301  VETGELENTYIIYTADHGYHIGQFGLVKGKSMPYDFDIRVPFFIRGPSVE   350

351  PGSIVPQIVLNIDLAPTILDIAGLDTPPDVDGKSVLKLLDPEKPGNRFRT   400
     |||||||||||||||||||||||||||||||||||||||||||||||||
351  PGSIVPQIVLNIDLAPTILDIAGLDTPPDVDGKSVLKLLDPEKPGNRFRT   400

401  NKKAKIWRDTFLVERG                                    416
     ||||||||||||||||
401  NKKAKIWRDTFLVERG                                    416
```

Sequence name: /tmp/JhwgRdKqmt/kqSmjxkWWk: SUL1_HUMAN (SEQ ID NO:1419)

Sequence documentation:

Alignment of: Z21368_PEA_1_P16 (SEQ ID NO:1292) x SUL1_HUMAN (SEQ ID NO:1419) ..

Alignment segment 1/1:

| | | | |
|---|---|---|---|
| Quality: | 3985.00 | Escore: | 0 |
| Matching length: | 397 | Total length: | 397 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MKYSCCALVLAVLGTELLGSLCSTVRSPRFRGRIQQERKNIRPNIILVLT    50
     |||||||||||||||||||||||||||||||||||||||||||||||||
  1  MKYSCCALVLAVLGTELLGSLCSTVRSPRFRGRIQQERKNIRPNIILVLT    50

51  DDQDVELGSLQVMNKTRKIMEHGGATFINAFVTTPMCCPSRSSMLTGKYV   100
     |||||||||||||||||||||||||||||||||||||||||||||||||
 51  DDQDVELGSLQVMNKTRKIMEHGGATFINAFVTTPMCCPSRSSMLTGKYV   100

101  HNHNVYTNNENCSSPSWQAMHEPRTFAVYLNNTGYRTAFFGKYLNEYNGS   150
     |||||||||||||||||||||||||||||||||||||||||||||||||
101  HNHNVYTNNENCSSPSWQAMHEPRTFAVYLNNTGYRTAFFGKYLNEYNGS   150

151  YIPPGWREWLGLIKNSRFYNYTVCRNGIKEKHGFDYAKDYFTDLITNESI   200
     |||||||||||||||||||||||||||||||||||||||||||||||||
151  YIPPGWREWLGLIKNSRFYNYTVCRNGIKEKHGFDYAKDYFTDLITNESI   200

201  NYFKMSKRMYPHRPVMMVISHAAPHGPEDSAPQFSKLYPNASQHITPSYN   250
     |||||||||||||||||||||||||||||||||||||||||||||||||
201  NYFKMSKRMYPHRPVMMVISHAAPHGPEDSAPQFSKLYPNASQHITPSYN   250

251  YAPNMDKHWIMQYTGPMLPIHMEFTNILQRKRLQTLMSVDDSVERLYNML   300
     |||||||||||||||||||||||||||||||||||||||||||||||||
251  YAPNMDKHWIMQYTGPMLPIHMEFTNILQRKRLQTLMSVDDSVERLYNML   300

301  VETGELENTYIIYTADHGYHIGQFGLVKGKSMPYDFDIRVPFFIRGPSVE   350
     |||||||||||||||||||||||||||||||||||||||||||||||||
301  VETGELENTYIIYTADHGYHIGQFGLVKGKSMPYDFDIRVPFFIRGPSVE   350

351  PGSIVPQIVLNIDLAPTILDIAGLDTPPDVDGKSVLKLLDPEKPGNR     397
     ||||||||||||||||||||||||||||||||||||||||||||||
351  PGSIVPQIVLNIDLAPTILDIAGLDTPPDVDGKSVLKLLDPEKPGNR     397
```

Sequence name: /tmp/GPlnIw3BOg/zXFdxqG4ow:
SUL1_HUMAN (SEQ ID NO:1419)
Sequence documentation:
Alignment of: Z21368_PEA__1_P22 (SEQ ID NO:1293) x
SUL1_HUMAN (SEQ ID NO:1419) ..
Alignment segment 1/1:

| | | | |
|---|---|---|---|
| Quality: | 1897.00 | Escore: | 0 |
| Matching length: | 188 | Total length: | 188 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKYSCCALVLAVLGTELLGSLCSTVRSPRFRGRIQQERKNIRPNIILVLT   50
    ||||||||||||||||||||||||||||||||||||||||||||||||||
  1 MKYSCCALVLAVLGTELLGSLCSTVRSPRFRGRIQQERKNIRPNIILVLT   50

51 DDQDVELGSLQVMNKTRKIMEHGGATFINAFVTTPMCCPSRSSMLTGKYV  100
    ||||||||||||||||||||||||||||||||||||||||||||||||||
 51 DDQDVELGSLQVMNKTRKIMEHGGATFINAFVTTPMCCPSRSSMLTGKYV  100

101 HNHNVYTNNENCSSPSWQAMHEPRTFAVYLNNTGYRTAFFGKYLNEYNGS  150
    ||||||||||||||||||||||||||||||||||||||||||||||||||
101 HNHNVYTNNENCSSPSWQAMHEPRTFAVYLNNTGYRTAFFGKYLNEYNGS  150

151 YIPPGWREWLGLIKNSRFYNYTVCRNGIKEKHGFDYAK              188
    |||||||||||||||||||||||||||||||||||||
151 YIPPGWREWLGLIKNSRFYNYTVCRNGIKEKHGFDYAK              188
```

Sequence name: /tmp/oji5Fs74fB/8xeB9KrGjp:Q7Z2W2
(SEQ ID NO:1697)
Sequence documentation:
Alignment of: Z21368_PEA__1_P23 (SEQ ID NO:1294) x
Q7Z2W2 (SEQ ID NO:1697) ..
Alignment segment 1/1:

| | | | |
|---|---|---|---|
| Quality: | 1368.00 | Escore: | 0.000511 |
| Matching length: | 137 | Total length: | 137 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKYSCCALVLAVLGTELLGSLCSTVRSPRFRGRIQQERKNIRPNIILVLT   50
    ||||||||||||||||||||||||||||||||||||||||||||||||||
  1 MKYSCCALVLAVLGTELLGSLCSTVRSPRFRGRIQQERKNIRPNIILVLT   50

51 DDQDVELGSLQVMNKTRKIMEHGGATFINAFVTTPMCCPSRSSMLTGKYV  100
    ||||||||||||||||||||||||||||||||||||||||||||||||||
 51 DDQDVELGSLQVMNKTRKIMEHGGATFINAFVTTPMCCPSRSSMLTGKYV  100

101 HNHNVYTNNENCSSPSWQAMHEPRTFAVYLNNTGYRT               137
    |||||||||||||||||||||||||||||||||||||
101 HNHNVYTNNENCSSPSWQAMHEPRTFAVYLNNTGYRT               137
```

Sequence name: /tmp/oji5Fs74fB/8xeB9KrGjp: SUL1_HUMAN (SEQ ID NO:1419)
Sequence documentation:
Alignment of: Z21368_PEA_1_P23 (SEQ ID NO:1294) x SUL1_HUMAN (SEQ ID NO:1419) ..
Alignment segment 1/1:

| | | | |
|---|---|---|---|
| Quality: | 1368.00 | Escore: | 0.000511 |
| Matching length: | 137 | Total length: | 137 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKYSCCALVLAVLGTELLGSLCSTVRSPRFRGRIQQERKNIRPNIILVLT   50
    ||||||||||||||||||||||||||||||||||||||||||||||||||
  1 MKYSCCALVLAVLGTELLGSLCSTVRSPRFRGRIQQERKNIRPNIILVLT   50

51 DDQDVELGSLQVMNKTRKIMEHGGATFINAFVTTPMCCPSRSSMLTGKYV  100
    ||||||||||||||||||||||||||||||||||||||||||||||||||
 51 DDQDVELGSLQVMNKTRKIMEHGGATFINAFVTTPMCCPSRSSMLTGKYV  100

101 HNHNVYTNNENCSSPSWQAMHEPRTFAVYLNNTGYRT               137
    ||||||||||||||||||||||||||||||||||||
101 HNHNVYTNNENCSSPSWQAMHEPRTFAVYLNNTGYRT               137
```

Expression of SUL1_HUMAN—Extracellular Sulfatase Sulf-1Z21368 Transcripts which are Detectable by Amplicon as Depicted in Sequence Name Z21368junc17-21 (SEQ ID NO:1642) in Normal and Cancerous Lung Tissues Expression of SUL1_HUMAN—Extracellular sulfatase Sulf-1 transcripts detectable by or according to junc17-21 segment, Z21368junc17-21 amplicon (SEQ ID NO:1642) and Z21368junc17-21F (SEQ ID NO:1640) Z21368junc17-21R (SEQ ID NO:1641) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 14:
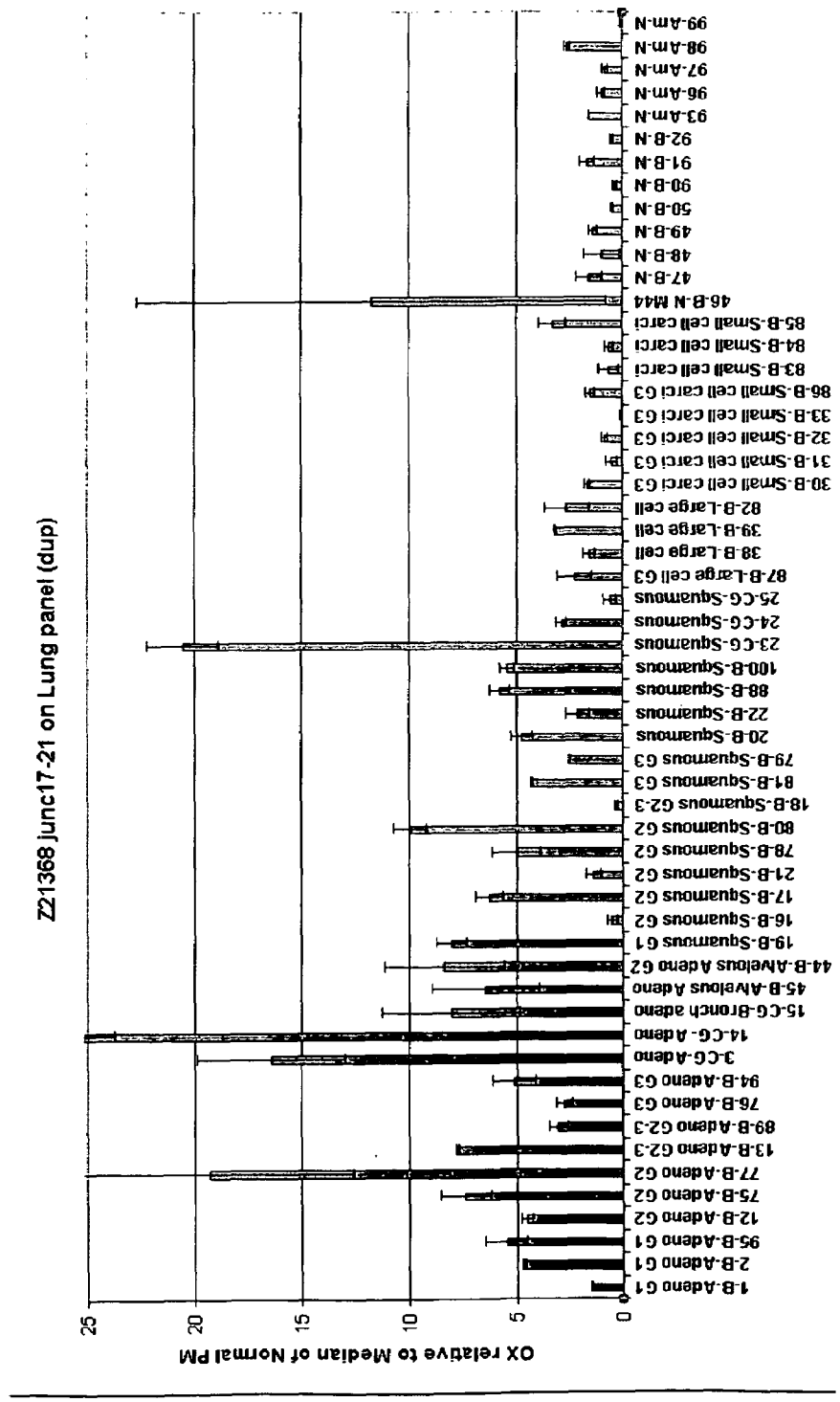
FIG. 14 is a histogram showing over expression of the Extracellular sulfatase Sulf-1 Z21368 transcripts, which are detectable by amplicon as depicted in sequence name Z21368junc17-21 (SEQ ID NO: 1642), in cancerous lung samples relative to the normal samples.

FIG. 14 is a histogram showing over expression of the above-indicated SUL1_HUMAN—Extracellular sulfatase Sulf-1 transcripts in cancerous lung samples relative to the normal samples. Values represent the average of duplicate experiments. Error bars indicate the minimal and maximal values obtained. As is evident from FIG. 14, the expression of SUL1_HUMAN—Extracellular sulfatase Sulf-1 transcripts detectable by the above amplicon in cancer samples was significantly higher than in the non-cancerous samples (Sample Nos. 47-50, 90-93, 96-99 Table 2, "Tissue samples in testing panel"). Notably an over-expression of at least 5 fold was found in 10 out of 15 adenocarcinoma samples, 7 out of 16 squamous cell carcinoma samples, 0 out of 4 large cell carcinoma samples and in 0 out of 8 small cells carcinoma samples.

Threshold of 5 fold over-expression was found to differentiate between cancer and normal samples with P value of 3.56E-04 in adenocarcinoma, 9.66E-03 in squamous cell carcinomas checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z21368junc17-21F forward primer (SEQ ID NO:1640); and Z21368junc17-21R reverse primer (SEQ ID NO: 1641).

The present invention also preferably encompasses any amplicon obtained through the use of any suitable primer pair; for example, for the above experiment, the following amplicon was obtained as a non-limiting illustrative example only of a suitable amplicon: Z21368junc17-21 (SEQ ID NO:1642).

```
Forward primer
                                       (SEQ ID NO:1640)
GGACGGATACAGCAGGAACG:

Reverse amplicon
                                       (SEQ ID NO:1641)
TATTTTCCAAAAAAGGCCAGCTC:

Amplicon
                                       (SEQ ID NO:1642)
GGACGGATACAGCAGGAACGAAAAAACATCCGACCCAACATTATTCTTGT
GCTTACCGATGATCAAGATGTGGAGCTGGCCTTTTTTGGAAAATA:
```

Expression of SUL1_HUMAN—Extracellular Sulfatase Sulf-1Z21368 Transcripts, which are Detectable by Amplicon as Depicted in Sequence Name Z21368 junc17-21 (SEQ ID NO: 1642) in Different Normal Tissues Expression of SUL1_HUMAN—Extracellular sulfatase Sulf-1 transcripts detectable by or according to Z21368 junc17-21 amplicon (SEQ ID NO:1642) and Z21368 junc17-21F (SEQ ID NO: 1640) and Z21368 junc17-21R (SEQ ID NO:1641) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35 Table 3, "Tissue samples in normal panel", above), to obtain a value of relative expression of each sample relative to median of the breast samples.

```
Forward primer
                                           (SEQ ID NO:1640)
GGACGGATACAGCAGGAACG:

Reverse amplicon
                                           (SEQ ID NO:1641)
TATTTTCCAAAAAAGGCCAGCTC:

Amplicon
                                           (SEQ ID NO:1642)
GGACGGATACAGCAGGAACGAAAAAACATCCGACCCAACATTATTCTTGT
GCTTACCGATGATCAAGATGTGGAGCTGGCCTTTTTTGGAAAATA:
```

Figure 15:
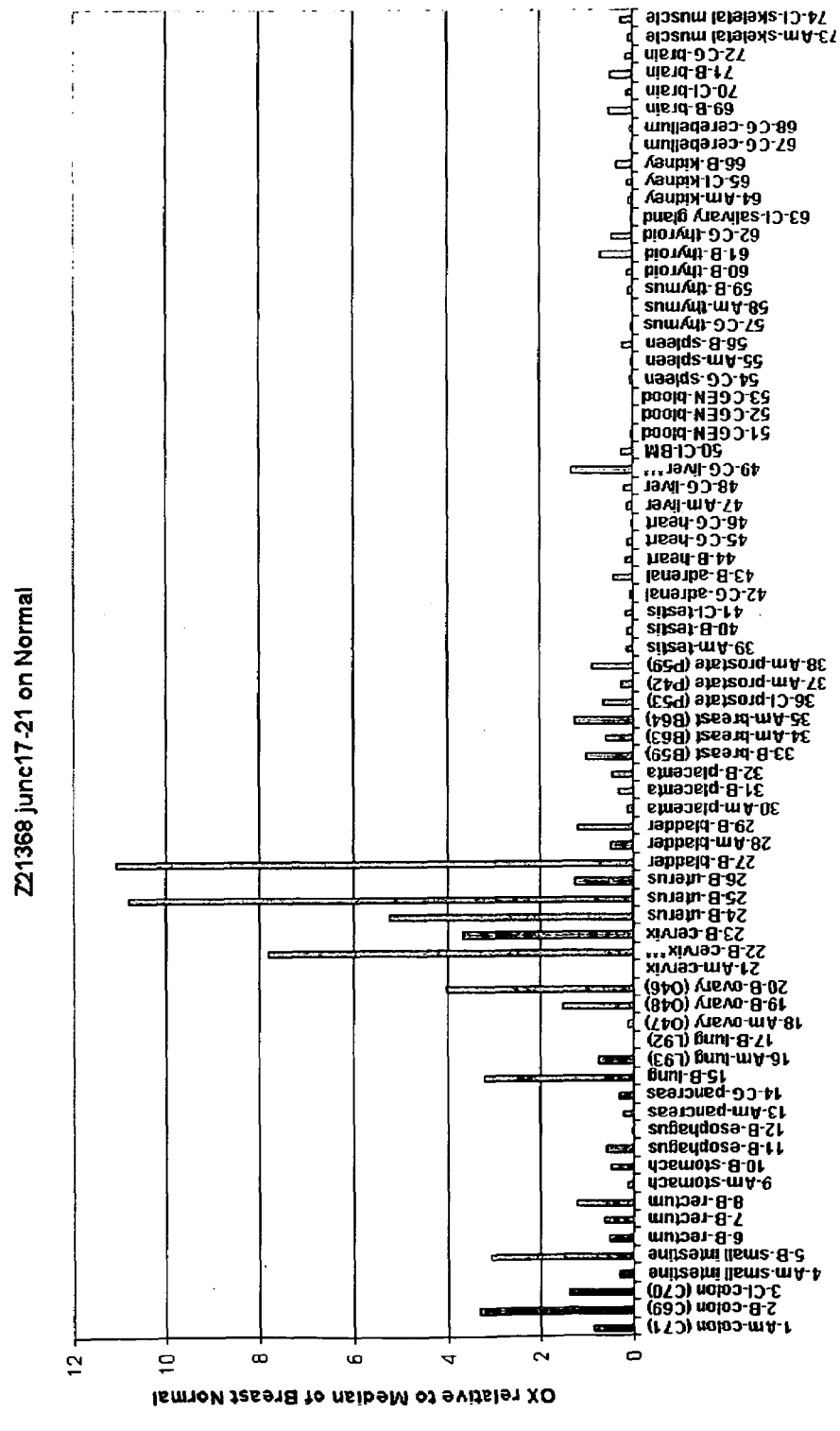
FIG. 15 is a histogram showing the expression of Extracellular sulfatase Sulf-1 Z21368 transcripts, which are detectable by amplicon as depicted in sequence name Z21368 junc17-21 (SEQ ID NO:1642), in different normal tissues.

The results are shown in FIG. 15, demonstrating the expression of Extracellular sulfatase Sulf-1Z21368 transcripts, which are detectable by amplicon as depicted in sequence name Z21368 junc17-21 (SEQ ID NO:1642), in different normal tissues.

Expression of SUL1_HUMAN—Extracellular
Sulfatase Sulf-1 Z21368 Transcripts which are
Detectable by Amplicon as Depicted in Sequence
Name Z21368seg39 (SEQ ID NO:1645) in Normal
and Cancerous Lung Tissues Expression of SUL1_HUMAN—Extracellular sulfatase Sulf-1 transcripts detectable by or according to seg39, Z21368seg39 amplicon (SEQ ID NO:1645) and primers Z21368seg39F (SEQ ID NO:1643) and Z21368seg39R (SEQ ID NO:1644) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel"), to obtain a value of fold up-regulation for each sample relative to median of the normal PM samples.

Figure 16:
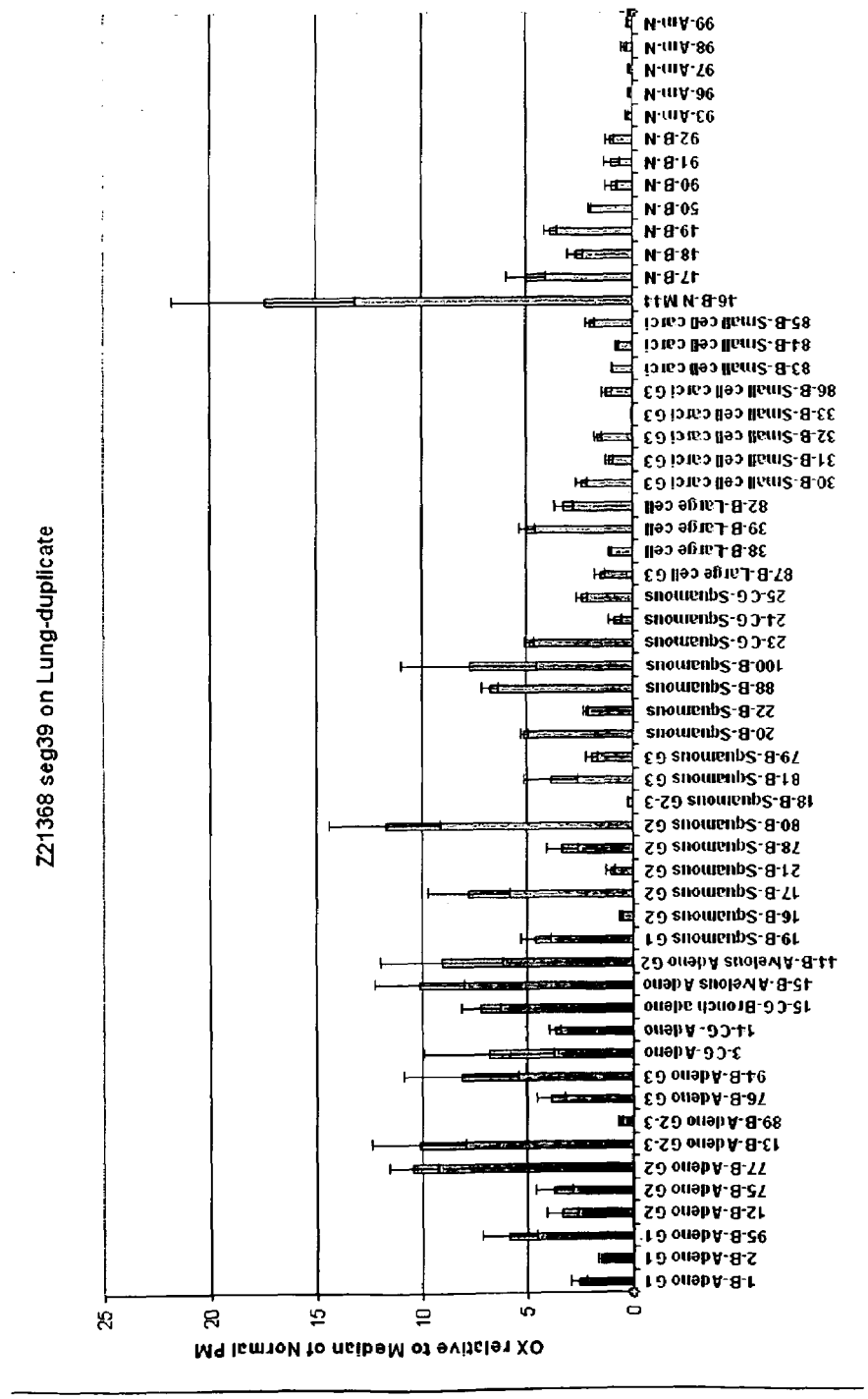
FIG. 16 is a histogram showing over expression of the SUL1_HUMAN-Extracellular sulfatase Sulf-1, Z21368 transcripts, which are detectable by amplicon as depicted in sequence name Z21368seg39 (SEQ ID NO: 1645), in cancerous lung samples relative to the normal samples.

FIG. 16 is a histogram showing over expression of the above-indicated SUL1_HUMAN—Extracellular sulfatase Sulf-1 transcripts in cancerous lung samples relative to the normal samples. Values represent the average of duplicate experiments. Error bars indicate the minimal and maximal values obtained.

As is evident from FIG. 16, the expression of SUL1_HUMAN—Extracellular sulfatase Sulf-1 transcripts detectable by the above amplicon in cancer samples was higher than in the non-cancerous samples (Sample Nos. 47-50, 90-93, 96-99 Table 2, "Tissue samples in testing panel"). Notably an over-expression of at least 5 fold was found in 8 out of 15 adenocarcinoma samples, 5 out of 16 squamous cell carcinoma samples and 1 out of 4 large cell carcinoma samples.

Statistical analysis was applied to verify the significance of these results, as described below.

The P value for the difference in the expression levels of SUL1_HUMAN—Extracellular sulfatase Sulf-1 transcripts detectable by the above amplicon in lung cancer samples versus the normal tissue samples was determined by T test as 2.17E-04 in adenocarcinoma, 9.94E-03 in squamous cell carcinoma and 2.17E-01 in large cell carcinoma.

Threshold of 5 fold overexpression was found to differentiate between cancer and normal samples with P value of 1.74E-02 in adenocarcinoma, 1.58E-01 in squamous cell carcinoma and 4.33E-01 in large cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z21368seg39F forward primer (SEQ ID NO:1643); and Z21368seg39R reverse primer (SEQ ID NO:1644).

The present invention also preferably encompasses any amplicon obtained through the use of any suitable primer pair; for example, for the above experiment, the following amplicon was obtained as a non-limiting illustrative example only of a suitable amplicon: Z21368seg39 (SEQ ID NO:1645).

Primers:

```
Forward Primer Z21368seg39F
                                           (SEQ ID NO:1643)
GTTGCATTTCTCAGTGCTGGTTT:

Reverse primer Z21368seg39R
                                           (SEQ ID NO:1644)
AGGGTGCCGGGTGAGG:

Amplicon Z21368seg39
                                           (SEQ ID NO:1645)
GTTGCATTTCTCAGTGCTGGTTTCTAATCAGACCAGTGGATTGAGTTTCT
CTACCATCCTCCCCACGTTCTTCTCTAAGCTGCCTCCAAGCCTCACCCGG
CACCCT:
```

Expression of SUL1_HUMAN—Extracellular
Sulfatase Sulf-1Z21368 Transcripts which are
Detectable by Amplicon as Depicted in Sequence
Name Z21368seg39 (SEQ ID NO:1645) in Different
Normal Tissues Expression of SUL1_HUMAN—Extracellular sulfatase Sulf-1 transcripts detectable by or according to Z21368seg39 amplicon (SEQ ID NO:1645) and Z21368seg39F (SEQ ID NO: 1643) Z21368seg39R (SEQ ID NO:1644) was measured by real time PCR. In parallel the expression of four housekeeping genes—[RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No. BC000449 (SEQ ID NO:1711); amplicon—Ubiquitin-amplicon, SEQ ID NO:328) and SDHA (GenBank Accession No. NM_004168

(SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35 Table 3, above), to obtain a value of relative expression of each sample relative to median of the breast samples.

```
Forward primer Z21368seg39F
                                    (SEQ ID NO:1643)
GTTGCATTTCTCAGTGCTGGTTT:

Reverse primer Z21368seg39R
                                    (SEQ ID NO:1644)
AGGGTGCCGGGTGAGG:

Amplicon Z21368seg39
                                    (SEQ ID NO:1645)
GTTGCATTTCTCAGTGCTGGTTTCTAATCAGACCAGTGGATTGAGTTTCT
CTACCATCCTCCCCACGTTCTTCTCTAAGCTGCCTCCAAGCCTCACCCGG
CACCCT:
```

Figure 17:
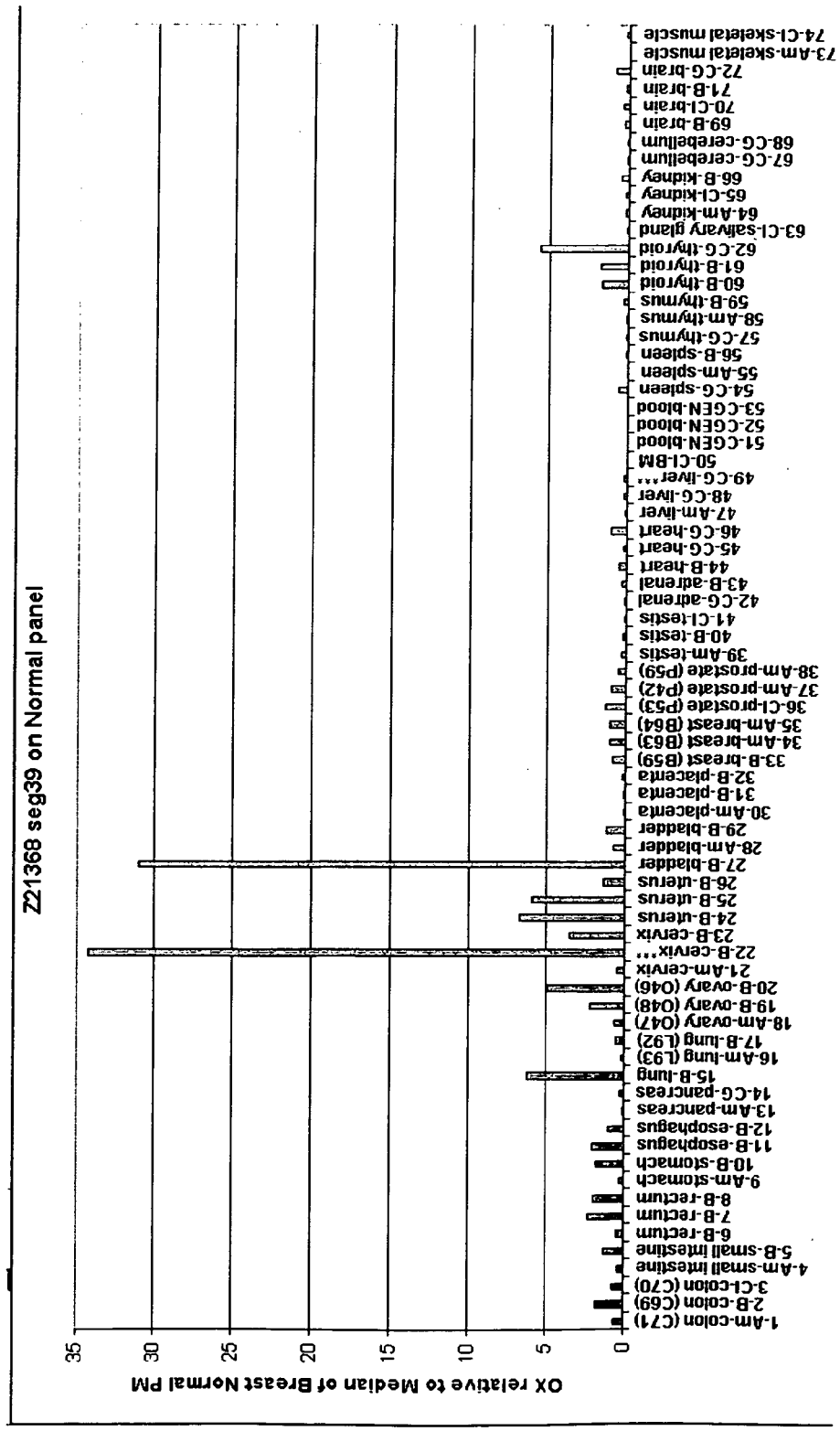
FIG. 17 is a histogram showing expression of SULL_HUMAN-Extracellular sulfatase Sulf-1, Z21368 transcripts, which are detectable by amplicon as depicted in sequence name Z21368seg39 (SEQ ID NO:1645), in different normal tissues.

The results are demonstrated in FIG. 17, showing expression of SUL1_HUMAN—Extracellular sulfatase Sulf-1, Z21368 transcripts, which are detectable by amplicon as depicted in sequence name Z21368seg39 (SEQ ID NO:1645), in different normal tissues.

PBGD-amplicon, SEQ ID NO:334HPRT1-amplicon, SEQ ID NO:1297Ubiquitin-amplicon, SEQ ID NO:328SDHA-amplicon, SEQ ID NO:331PBGD-amplicon, SEQ ID NO:334HPRT1-amplicon, SEQ ID NO:1297Ubiquitin-amplicon, SEQ ID NO:328SDHA-amplicon, SEQ ID NO:331RPL19 amplicon, SEQ ID NO:1630TATA amplicon, SEQ ID NO:1633Ubiquitin-amplicon, SEQ ID NO:328SDHA-amplicon, SEQ ID NO:331

Description for Cluster HUMGRP5E

Cluster HUMGRP5E features 2 transcript(s) and 5 segment(s) of interest, the names for which are given in Tables 160 and 161, respectively, the sequences themselves are given at the end of the application. The selected protein variants are given in table 162.

TABLE 160

Transcripts of interest

| Transcript Name | Sequence ID No. |
|---|---|
| HUMGRP5E_T4 | 20 |
| HUMGRP5E_T5 | 21 |

TABLE 161

Segments of interest

| Segment Name | Sequence ID No. |
|---|---|
| HUMGRP5E_node_0 | 335 |
| HUMGRP5E_node_2 | 336 |
| HUMGRP5E_node_8 | 337 |
| HUMGRP5E_node_3 | 338 |
| HUMGRP5E_node_7 | 339 |

TABLE 162

Proteins of interest

| Protein Name | Sequence ID No. |
|---|---|
| HUMGRP5E_P4 | 1299 |
| HUMGRP5E_P5 | 1300 |

These sequences are variants of the known protein Gastrin-releasing peptide precursor (SwissProt accession identifier GRP_HUMAN; known also according to the synonyms GRP; GRP-10), SEQ ID NO:1421, referred to herein as the previously known protein.

Gastrin-releasing peptide is known or believed to have the following function(s): stimulates gastrin release as well as other gastrointestinal hormones. The sequence for protein Gastrin-releasing peptide precursor (SEQ ID NO:1421) is given at the end of the application, as "Gastrin-releasing peptide precursor amino acid sequence". Known polymorphisms for this sequence are as shown in Table 163.

TABLE 163

Amino acid mutations for Known Protein

| SNP position(s) on amino acid sequence | Comment |
|---|---|
| 4 | S -> R |

Protein Gastrin-releasing peptide localization is believed to be Secreted.

The previously known protein also has the following indication(s) and/or potential therapeutic use(s): Diabetes, Type II. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bombesin antagonist; Insulinotropin agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anorectic/Antiobesity; Releasing hormone; Anticancer; Respiratory; Antidiabetic.

The following GO Annotation(s) apply to the previously known protein. The following annotation(s) were found: signal transduction; neuropeptide signaling pathway, which are annotation(s) related to Biological Process; growth factor, which are annotation(s) related to Molecular Function; and secreted, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

As noted above, cluster HUMGRP5E features 2 transcript(s), which were listed in Table 160 above. These transcript(s) encode for protein(s) which are variant(s) of protein Gastrin-releasing peptide precursor (SEQ ID NO:1421). A description of each variant protein according to the present invention is now provided.

Variant protein HUMGRP5E_P4 (SEQ ID NO:1299) according to the present invention has an amino acid sequence as given at the end of the application; it is encoded by transcript(s) HUMGRP5E_T4 (SEQ ID NO:20). An alignment is given to the known protein (Gastrin-releasing peptide precursor (SEQ ID NO:1421)) at the end of the application. One or more alignments to one or more previously published protein sequences are given at the end of the application. A brief description of the relationship of the variant protein according to the present invention to each such aligned protein is as follows:

Comparison Report Between HUMGRP5E_P4 (SEQ ID NO:1299) and GRP_HUMAN (SEQ ID NO:1421):

1. An isolated chimeric polypeptide encoding for HUMGRP5E_P4 (SEQ ID NO:1299), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN (SEQ ID NO:1421), which also corresponds to amino acids 1-127 of HUMGRP5E_P4 (SEQ ID NO:1299), and a second amino acid sequence being at least 90% homologous to GSQREGRNPQLNQQ corresponding to amino acids 135-148 of GRP_HUMAN (SEQ ID NO:1421), which also corresponds to amino acids 128-141 of HUMGRP5E_P4 (SEQ ID NO:1299), wherein said first and second amino acid sequences are contiguous and in a sequential order.

2. An isolated chimeric polypeptide encoding for an edge portion of HUMGRP5E_P4 (SEQ ID NO:1299), comprising a polypeptide having a length "n", wherein n is at least about amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127-x to 127; and ending at any of amino acid numbers 128+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P4 (SEQ ID NO:1299) also has the following non-silent SNPs (Single Nucleotide Polymorphisms) as listed in Table 164, (given according to their position(s) on the amino acid sequence, with the alternative amino acid(s) listed; the last column indicates whether the SNP is known or not; the presence of known SNPs in variant protein HUMGRP5E_P4 (SEQ ID NO:1299) sequence provides support for the deduced sequence of this variant protein according to the present invention).

TABLE 164

Amino acid mutations

| SNP position(s) on amino acid sequence | Alternative amino acid(s) | Previously known SNP? |
|---|---|---|
| 4 | S -> R | Yes |

Variant protein HUMGRP5E_P4 (SEQ ID NO:1299) is encoded by the following transcript(s): HUMGRP5E_T4 (SEQ ID NO:20), for which the sequence(s) is/are given at the end of the application. The coding portion of transcript HUMGRP5E_T4 (SEQ ID NO:20) is shown in bold; this coding portion starts at position 622 and ends at position 1044. The transcript also has the following SNPs as listed in Table 165 (given according to their position on the nucleotide sequence, with the alternative nucleic acid listed; the last column indicates whether the SNP is known or not; the presence of known SNPs in variant protein HUMGRP5E_P4 (SEQ ID NO:1299) sequence provides support for the deduced sequence of this variant protein according to the present invention).

TABLE 165

Nucleic acid SNPs

| SNP position on nucleotide sequence | Alternative nucleic acid | Previously known SNP? |
|---|---|---|
| 541 | -> T | No |
| 542 | G -> T | No |
| 631 | A -> C | Yes |
| 672 | G -> A | Yes |
| 1340 | C -> | No |
| 1340 | C -> A | No |
| 1341 | A -> | No |
| 1341 | A -> G | No |

Variant protein HUMGRP5E_P5 (SEQ ID NO:1300) according to the present invention has an amino acid sequence as given at the end of the application; it is encoded by transcript(s) HUMGRP5E_T5 (SEQ ID NO:21). An alignment is given to the known protein (Gastrin-releasing peptide precursor (SEQ ID NO:1421)) at the end of the application. One or more alignments to one or more previously published protein sequences are given at the end of the application. A brief description of the relationship of the variant protein according to the present invention to each such aligned protein is as follows:

Comparison Report Between HUMGRP5E_P5 (SEQ ID NO:1300) and GRP_HUMAN (SEQ ID NO:1421):

1. An isolated chimeric polypeptide encoding for HUMGRP5E_P5 (SEQ ID NO:1300), comprising a first amino acid sequence being at least 90% homologous to MRGSELPLVLLALVLCLAPRGRAV-PLPAGGGTVLTKMYPRGNHWAVGHLMGKKSTG ESSSVSERGSLKQQLREYIRWEEAARN-LLGLIEAKENRNHQPPQPKALGNQQPSWDSED SSN-FKDVGSKGK corresponding to amino acids 1-127 of GRP_HUMAN (SEQ ID NO:1421), which also corresponds to amino acids 1-127 of HUMGRP5E_P5 (SEQ ID NO:1300), and a second amino acid sequence being at least 70%, optionally at least 80%, preferably at least 85%, more preferably at least 90% and most preferably at least 95% homologous to a polypeptide having the sequence DSLLQV-LNVKEGTPS (SEQ ID NO:1764) corresponding to amino acids 128-142 of HUMGRP5E_P5 (SEQ ID NO:1300), wherein said first and second amino acid sequences are contiguous and in a sequential order.

2. An isolated polypeptide encoding for a tail of HUMGRP5E_P5 (SEQ ID NO:1300), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO:1764) in HUMGRP5E_P5 (SEQ ID NO:1300).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P5 (SEQ ID NO:1300) also has the following non-silent SNPs (Single Nucleotide Polymorphisms) as listed in Table 166, (given according to their position(s) on the amino acid sequence, with the alternative amino acid(s) listed; the last column indicates whether the SNP is known or not; the presence of known SNPs in variant protein HUMGRP5E_P5 (SEQ ID NO:1300) sequence provides support for the deduced sequence of this variant protein according to the present invention).

TABLE 166

Amino acid mutations

| SNP position(s) on amino acid sequence | Alternative amino acid(s) | Previously known SNP? |
|---|---|---|
| 4 | S -> R | Yes |

Variant protein HUMGRP5E_P5 (SEQ ID NO:1300) is encoded by the following transcript(s): HUMGRP5E_T5 (SEQ ID NO:21), for which the sequence(s) is/are given at the end of the application. The coding portion of transcript HUMGRP5E_T5 (SEQ ID NO:21) is shown in bold; this coding portion starts at position 622 and ends at position 1047. The transcript also has the following SNPs as listed in Table 167 (given according to their position on the nucleotide sequence, with the alternative nucleic acid listed; the last column indicates whether the SNP is known or not; the presence of known SNPs in variant protein HUMGRP5E_P5 (SEQ ID NO:1300) sequence provides support for the deduced sequence of this variant protein according to the present invention).

TABLE 167

Nucleic acid SNPs

| SNP position on nucleotide sequence | Alternative nucleic acid | Previously known SNP? |
|---|---|---|
| 541 | -> T | No |
| 542 | G -> T | No |
| 631 | A -> C | Yes |
| 672 | G -> A | Yes |
| 1354 | C -> | No |
| 1354 | C -> A | No |
| 1355 | A -> | No |
| 1355 | A -> G | No |

As noted above, cluster HUMGRP5E features 5 segment(s), which were listed in Table 161 above and for which the sequence(s) are given at the end of the application. These segment(s) are portions of nucleic acid sequence(s) which are described herein separately because they are of particular interest. A description of each segment according to the present invention is now provided.

Segment cluster HUMGRP5E_node_0 (SEQ ID NO:1130) according to the present invention is supported by 21 libraries. The number of libraries was determined as previously described. This segment can be found in the following transcript(s): HUMGRP5E_T4 (SEQ ID NO:20) and HUMGRP5E_T5 (SEQ ID NO:21). Table 168 below describes the starting and ending position of this segment on each transcript.

TABLE 168

Segment location on transcripts

| Transcript name | Segment starting position | Segment ending position |
|---|---|---|
| HUMGRP5E_T4 (SEQ ID NO: 20) | 1 | 760 |
| HUMGRP5E_T5 (SEQ ID NO: 21) | 1 | 760 |

Segment cluster HUMGRP5E_node_2 (SEQ ID NO:1131) according to the present invention is supported by 27 libraries. The number of libraries was determined as previously described. This segment can be found in the following transcript(s): HUMGRP5E_T4 (SEQ ID NO:20) and HUMGRP5E_T5 (SEQ ID NO:21). Table 169 below describes the starting and ending position of this segment on each transcript.

TABLE 169

Segment location on transcripts

| Transcript name | Segment starting position | Segment ending position |
|---|---|---|
| HUMGRP5E_T4 (SEQ ID NO: 20) | 761 | 984 |
| HUMGRP5E_T5 (SEQ ID NO: 21) | 761 | 984 |

Segment cluster HUMGRP5E_node_8 (SEQ ID NO:1132) according to the present invention is supported by 26 libraries. The number of libraries was determined as previously described. This segment can be found in the following transcript(s): HUMGRP5E_T4 (SEQ ID NO:20) and HUMGRP5E_T5 (SEQ ID NO:21). Table 170 below describes the starting and ending position of this segment on each transcript.

TABLE 170

Segment location on transcripts

| Transcript name | Segment starting position | Segment ending position |
|---|---|---|
| HUMGRP5E_T4 (SEQ ID NO: 20) | 1004 | 1362 |
| HUMGRP5E_T5 (SEQ ID NO: 21) | 1018 | 1376 |

According to an optional embodiment of the present invention, short segments related to the above cluster are also provided. These segments are up to about 120 bp in length, and so are included in a separate description.

Segment cluster HUMGRP5E_node_3 (SEQ ID NO:1133) according to the present invention can be found in the following transcript(s): HUMGRP5E_T4 (SEQ ID NO:20) and HUMGRP5E_T5 (SEQ ID NO:21). Table 171 below describes the starting and ending position of this segment on each transcript.

TABLE 171

Segment location on transcripts

| Transcript name | Segment starting position | Segment ending position |
|---|---|---|
| HUMGRP5E_T4 (SEQ ID NO: 20) | 985 | 1003 |
| HUMGRP5E_T5 (SEQ ID NO: 21) | 985 | 1003 |

Segment cluster HUMGRP5E_node_7 (SEQ ID NO:1134) according to the present invention can be found in the following transcript(s): HUMGRP5E_T5 (SEQ ID NO:21). Table 172 below describes the starting and ending position of this segment on each transcript.

TABLE 172

Segment location on transcripts

| Transcript name | Segment starting position | Segment ending position |
|---|---|---|
| HUMGRP5E_T5 (SEQ ID NO: 21) | 1004 | 1017 |

Microarray (chip) data is also available for this gene as follows. As described above with regard to the cluster itself, various oligonucleotides were tested for being differentially expressed in various disease conditions, particularly cancer. The following oligonucleotides were found to hit this segment (with regard to lung cancer), shown in Table 173.

TABLE 173

Oligonucleotides related to this gene

| Oligonucleotide name | Overexpressed in cancers | Chip reference |
|---|---|---|
| HUMGRP5E_0_0_16630 | Lung cancer | Lung |
| HUMGRP5E_0_2_0 | Lung cancer | Lung |

Variant Protein Alignment to the Previously Known Protein:

Sequence name: /tmp/412zs2mwyT/B0wjOUAX0d:GRP_HUMAN (SEQ ID NO:1421)

Sequence documentation:

Alignment of: HUMGRP5E_P4 (SEQ ID NO:1299) x GRP_HUMAN (SEQ ID NO:1421) ..

Alignment segment 1/1:

| Quality: | 1291.00 | Escore: | 0 |
|---|---|---|---|
| Matching length: | 141 | Total length: | 148 |
| Matching Percent Similarity: | 100.00 | Matching Percent Identity: | 100.00 |
| Total Percent Similarity: | 95.27 | Total Percent Identity: | 95.27 |
| Gaps: | 1 | | |

Alignment:

```
  1  MRGSELPLVLLALVLCLAPRGRAVPLPAGGGTVLTKMYPRGNHWAVGHLM   50
     ||||||||||||||||||||||||||||||||||||||||||||||||||
  1  MRGSELPLVLLALVLCLAPRGRAVPLPAGGGTVLTKMYPRGNHWAVGHLM   50

51  GKKSTGESSSVSERGSLKQQLREYIRWEEAARNLLGLIEAKENRNHQPPQ  100
     ||||||||||||||||||||||||||||||||||||||||||||||||||
 51  GKKSTGESSSVSERGSLKQQLREYIRWEEAARNLLGLIEAKENRNHQPPQ  100

101  PKALGNQQPSWDSEDSSNFKDVGSKGK.......GSQREGRNPQLNQQ   141
     ||||||||||||||||||||||||||        |||||||||||||||
101  PKALGNQQPSWDSEDSSNFKDVGSKGKVGRLSAPGSQREGRNPQLNQQ   148
```

Sequence name: /tmp/1me91dnvfv/KbP5io8PtU:GRP_HUMAN (SEQ ID NO:1421)

Sequence documentation:

Alignment of: HUMGRP5E_P5 (SEQ ID NO:1300) x GRP_HUMAN (SEQ ID NO:1421) ..

Alignment segment 1/1:

| Quality: | 1248.00 | Escore: | 0 |
|---|---|---|---|
| Matching length: | 127 | Total length: | 127 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MRGSELPLVLLALVLCLAPRGRAVPLPAGGGTVLTKMYPRGNHWAVGHLM   50
     ||||||||||||||||||||||||||||||||||||||||||||||||||
  1  MRGSELPLVLLALVLCLAPRGRAVPLPAGGGTVLTKMYPRGNHWAVGHLM   50

51  GKKSTGESSSVSERGSLKQQLREYIRWEEAARNLLGLIEAKENRNHQPPQ  100
     ||||||||||||||||||||||||||||||||||||||||||||||||||
 51  GKKSTGESSSVSERGSLKQQLREYIRWEEAARNLLGLIEAKENRNHQPPQ  100

101  PKALGNQQPSWDSEDSSNFKDVGSKGK                         127
     |||||||||||||||||||||||||||
101  PKALGNQQPSWDSEDSSNFKDVGSKGK                         127
```

Expression of GRP_HUMAN—Gastrin-releasing Peptide (HUMGRP5E) Transcripts which are Detectable by Amplicon as Depicted in Sequence Name HUMGRP5Ejunc3-7 (SEQ ID NO:1648) in Normal and Cancerous Lung Tissues Expression of GRP_HUMAN—gastrin-releasing peptide transcripts detectable by or according to HUMGRP5Ejunc3-7 amplicon (SEQ ID NO:1648) and HUMGRP5Ejunc3-7F (SEQ ID NO:1646) and HUMGRP5Ejunc3-7R (SEQ ID NO:1647) primers was measured by real time PCR. In parallel the expression of four housekeeping genes PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing sample",), to obtain a value of fold up-regulation for each sample relative to median of the normal PM samples.

Figure 19:
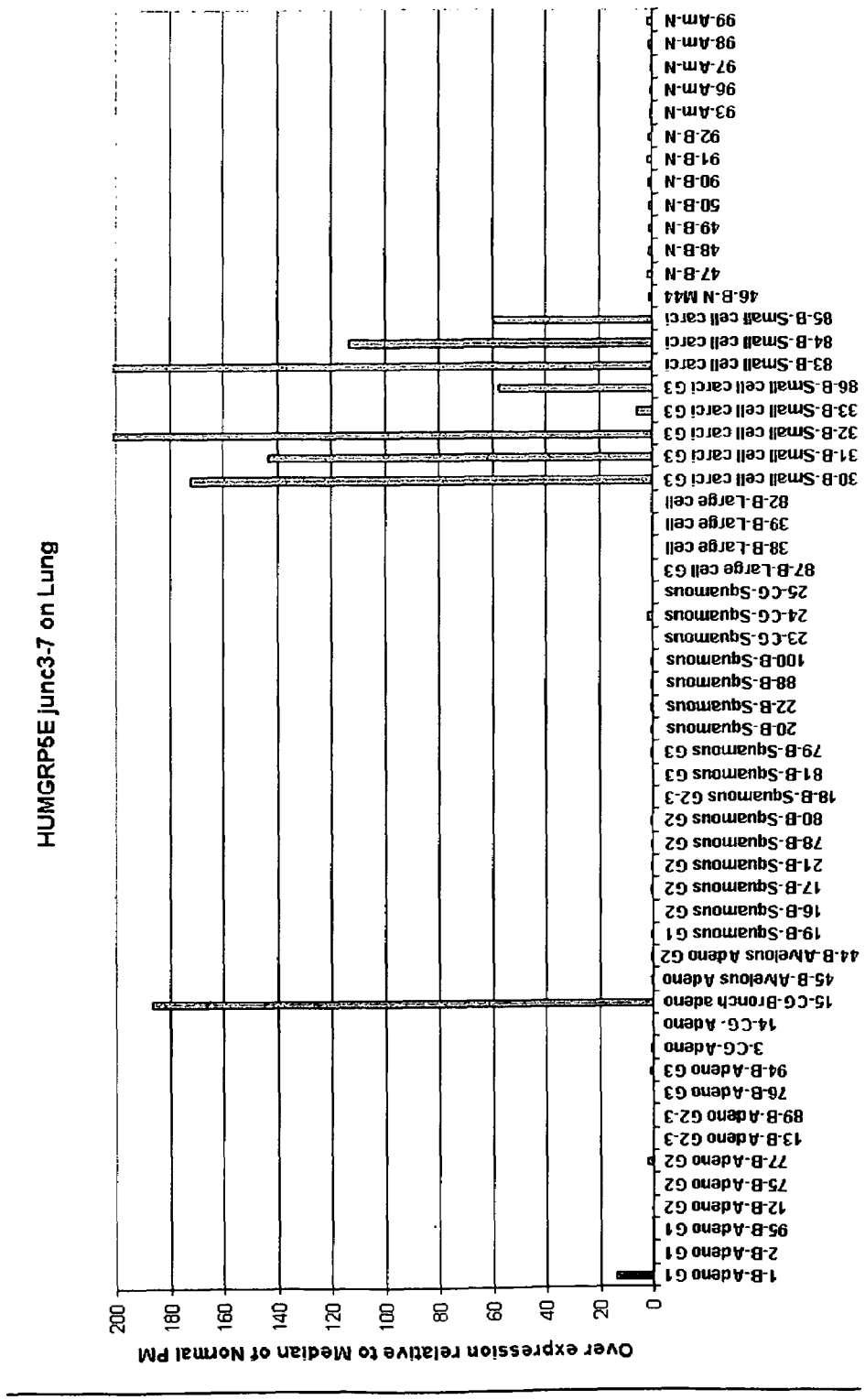
FIG. 19 is a histogram showing over expression of the gastrin-releasing peptide (HUMGRP5E) transcripts, which are detectable by amplicon as depicted in sequence name HUMGRP5Ejunc3-7 (SEQ ID NO: 1648), in several cancerous lung samples relative to the normal samples.

FIG. 19 is a histogram showing over expression of the above-indicated GRP_HUMAN—gastrin-releasing peptide transcripts in several cancerous lung samples relative to the normal samples. As is evident from FIG. 19, the expression of GRP_HUMAN—gastrin-releasing peptide transcripts detectable by the above amplicon in several cancer samples was significantly higher than in the non-cancerous samples (Sample Nos. 47-50, 90-93, 96-99, Table 2, "Tissue samples in testing sample"). Notably an over-expression of at least 10 fold was found in 2 out of 15 adenocarcinoma samples, and in 7 out of 8 small cells carcinoma samples.

Primer pairs are also optionally and preferably encompassed within the present invention; for example, for the above experiment, the following primer pair was used as a non-limiting illustrative example only of a suitable primer pair: HUMGRP5Ejunc3-7F forward primer (SEQ ID NO:1646); and HUMGRP5Ejunc3-7R reverse primer (SEQ ID NO:1647).

The present invention also preferably encompasses any amplicon obtained through the use of any suitable primer pair; for example, for the above experiment, the following amplicon was obtained as a non-limiting illustrative example only of a suitable amplicon:

HUMGRP5Ejunc3-7.
(SEQ ID NO:1648)

HUMGRP5Ejunc3-7F
(SEQ ID NO:1646)
ACCAGCCACCTCAACCCA

HUMGRP5Ejunc3-7R
(SEQ ID NO:1647)
CTGGAGCAGAGAGTCTTTGCCT

HUMGRP5Ejunc3-7
(SEQ ID NO:1648)
ACCAGCCACCTCAACCCAAGGCCCTGGGCAATCAGCAGCCTTCGTGGGAT
TCAGAGGATAGCAGCAACTTCAAAGATGTAGGTTCAAAAGGCAAAGACTC
TCTGCTCCAG Expression of GRP_HUMAN—Gastrin-Releasing Peptide (HUMGRP5E) Transcripts which are Detectable by Amplicon as Depicted in Sequence Name HUMGRP5Ejunc3-7 (SEQ ID NO:1648) in Different Normal Tissues Expression of GRP_HUMAN—gastrin-releasing peptide transcripts detectable by or according to HUMGRP5Ejunc3-7 amplicon (SEQ ID NO:1648) and HUMGRP5Ejunc3-7F (SEQ ID NO:1646) and HUMGRP5Ejunc3-7R (SEQ ID NO:1647) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35, Table 3, "Tissue samples on normal panel", above), to obtain a value of relative expression of each sample relative to median of the breast samples.

HUMGRP5Ejunc3-7F
(SEQ ID NO:1646)
ACCAGCCACCTCAACCCA

HUMGRP5Ejunc3-7R

-continued

CTGGAGCAGAGAGTCTTTGCCT (SEQ ID NO:1647)

Figure 20:
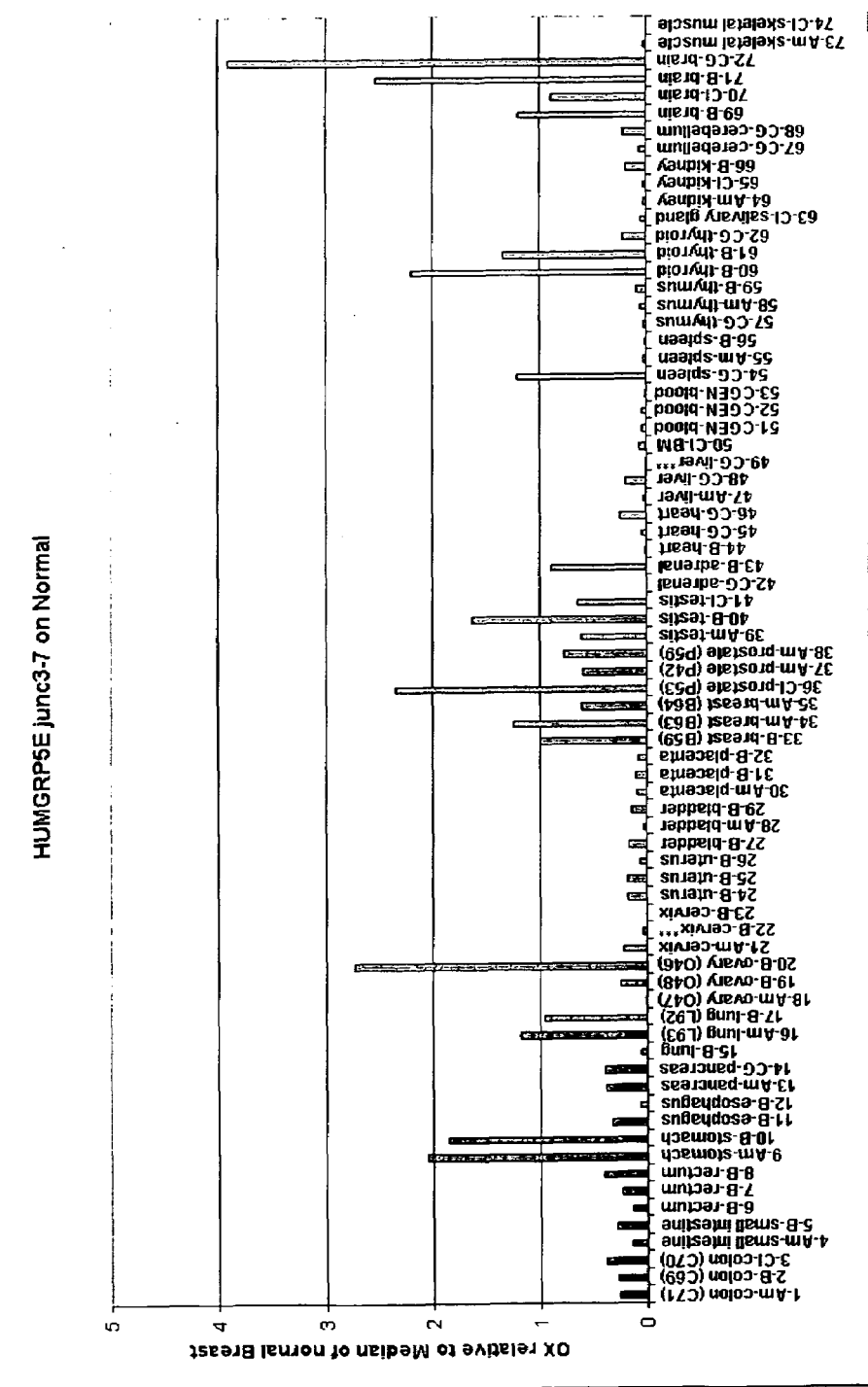
FIG. 20 is a histogram showing the expression of gastrin-releasing peptide (HUMGRP5E) transcripts, which are detectable by amplicon as depicted in sequence name HUMGRP5Ejunc3-7 (SEQ ID NO: 1648), in different normal tissues.

HUMGRP5Ejunc3-7 (SEQ ID NO:1648)
ACCAGCCACCTCAACCCAAGGCCCTGGGCAATCAGCAGCCTTCGTGGGAT
TCAGAGGATAGCAGCAACTTCAAAGATGTAGGTTCAAAAGGCAAAGACTC
TCTGCTCCAG The results are shown in FIG. 20, demonstrating the expression of GRP_HUMAN—gastrin-releasing peptide (HUMGRP5E) transcripts which are detectable by amplicon as depicted in sequence name HUMGRP5Ejunc3-7 in different normal tissues.

Description for Cluster D56406

Cluster D56406 features 3 transcript(s) and 10 segment(s) of interest, the names for which are given in Tables 174 and 175, respectively, the sequences themselves are given at the end of the application. The selected protein variants are given in table 176.

TABLE 174

Transcripts of interest

| Transcript Name | Sequence ID No. |
|---|---|
| D56406_PEA_1_T3 | 22 |
| D56406_PEA_1_T6 | 23 |
| D56406_PEA_1_T7 | 24 |

TABLE 175

Segments of interest

| Segment Name | Sequence ID No. |
|---|---|
| D56406_PEA_1_node_0 | 340 |
| D56406_PEA_1_node_13 | 341 |
| D56406_PEA_1_node_11 | 342 |
| D56406_PEA_1_node_2 | 343 |
| D56406_PEA_1_node_3 | 344 |
| D56406_PEA_1_node_5 | 345 |
| D56406_PEA_1_node_6 | 346 |
| D56406_PEA_1_node_7 | 347 |
| D56406_PEA_1_node_8 | 348 |
| D56406_PEA_1_node_9 | 349 |

TABLE 176

Proteins of interest

| Protein Name | Sequence ID No. |
|---|---|
| D56406_PEA_1_P2 | 1301 |
| D56406_PEA_1_P5 | 1302 |
| D56406_PEA_1_P6 | 1303 |

These sequences are variants of the known protein Neurotensin/neuromedin N precursor [Contains: Large neuromedin N (NmN-125); Neuromedin N (NmN) (NN); Neurotensin (NT); Tail peptide] (SwissProt accession identifier NEUT_HUMAN), SEQ ID NO:1422, referred to herein as the previously known protein.

Protein Neurotensin/neuromedin N precursor is known or believed to have the following function(s): Neurotensin may play an endocrine or paracrine role in the regulation of fat metabolism. It causes contraction of smooth muscle. The sequence for protein Neurotensin/neuromedin N precursor is given at the end of the application, as "Neurotensin/neuromedin N precursor [Contains: Large neuromedin N (NmN-125); Neuromedin N (NmN) (NN); Neurotensin (NT); Tail peptide] amino acid sequence". Protein Neurotensin/neuromedin N precursor localization is believed to be Secreted; Packaged within secretory vesicles.

The following GO Annotation(s) apply to the previously known protein. The following annotation(s) were found: signal transduction, which are annotation(s) related to Biological Process; neuropeptide hormone, which are annotation(s) related to Molecular Function; and extracellular; soluble fraction, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

As noted above, cluster D56406 features 3 transcript(s), which were listed in Table 174 above. These transcript(s) encode for protein(s) which are variant(s) of protein Neurotensin/neuromedin N precursor. A description of each variant protein according to the present invention is now provided.

Variant protein D56406_PEA_1_P2 (SEQ ID NO:1301) according to the present invention has an amino acid sequence as given at the end of the application; it is encoded by transcript(s) D56406_PEA_1_T3 (SEQ ID NO:22). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison Report Between D56406_PEA_1_P2 (SEQ ID NO:1301) and NEUT_HUMAN (SEQ ID NO:1422):

1. An isolated chimeric polypeptide encoding for D56406_PEA_1_P2 (SEQ ID NO:1301) comprising a first amino acid sequence being at least 90% homologous to MMAGMKIQLVCMLLLAFSSWSLCSD-SEEEMKALEADFLTNMHTSKISKAHVPSWKMT LLN-VCSLVNNLNSPAEETGEVHEEELVA-RRKLPTALDGFSLEAMLTIYQLHKICHSRAF QHWE corresponding to amino acids 1-120 of NEUT_HUMAN (SEQ ID NO:1422), which also corresponds to amino acids 1-120 of D56406_PEA_1_P2 (SEQ ID NO:1301), second amino acid sequence being at least 70%, optionally at least 80%, preferably at least 85%, more preferably at least 90% and most preferably at least 95% homologous to a polypeptide having the sequence ARWLTPVIPALWEA-ETGGSRGQEMETIPANT (SEQ ID NO:1773) corresponding to amino acids 121-151 of D56406_PEA_1_P2 (SEQ ID NO:1301), and a third amino acid sequence being at least 90% homologous to LIQEDILDTGNDKNGKEE-VIKRKIPYILKRQLYENKPRRPYILKRDSYYY corresponding to amino acids 121-170 of NEUT_HUMAN (SEQ ID NO:1422), which also corresponds to amino acids 152-201 of D56406_PEA_1_P2 (SEQ ID NO:1301), wherein said first, second and third amino acid sequences are contiguous and in a sequential order.

2. An isolated polypeptide encoding for an edge portion of D56406_PEA_1_P2 (SEQ ID NO:1301), comprising an amino acid sequence being at least 70%, optionally at least about 80%, preferably at least about 85%, more preferably at least about 90% and most preferably at least about 95% homologous to the sequence encoding for ARWLTPVIPAL- WEAETGGSRGQEMETIPANT (SEQ ID NO:1773), corresponding to D56406_PEA_1_P2 (SEQ ID NO:1301).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P2 (SEQ ID NO:1301) also has the following non-silent SNPs (Single Nucleotide Polymorphisms) as listed in Table 177, (given according to their position(s) on the amino acid sequence, with the alternative amino acid(s) listed; the last column indicates whether the SNP is known or not; the presence of known SNPs in variant protein D56406_PEA_1_P2 (SEQ ID NO:1301) sequence provides support for the deduced sequence of this variant protein according to the present invention).

TABLE 177

Amino acid mutations

| SNP position(s) on amino acid sequence | Alternative amino acid(s) | Previously known SNP? |
|---|---|---|
| 30 | M -> V | No |
| 44 | S -> P | No |
| 84 | V -> | No |
| 84 | V -> A | No |

Variant protein D56406_PEA_1_P2 (SEQ ID NO:1301) is encoded by the following transcript(s): D56406_PEA_1_T3 (SEQ ID NO:22), for which the sequence(s) is/are given at the end of the application. The coding portion of transcript D56406_PEA_1_T3 (SEQ ID NO:22) is shown in bold; this coding portion starts at position 106 and ends at position 708. The transcript also has the following SNPs as listed in Table 178 (given according to their position on the nucleotide sequence, with the alternative nucleic acid listed; the last column indicates whether the SNP is known or not; the presence of known SNPs in variant protein D56406_PEA_1_P2 (SEQ ID NO:1301) sequence provides support for the deduced sequence of this variant protein according to the present invention).

TABLE 178

Nucleic acid SNPs

| SNP position on nucleotide sequence | Alternative nucleic acid | Previously known SNP? |
|---|---|---|
| 94 | G -> T | No |
| 95 | A -> T | No |
| 858 | T -> G | Yes |
| 103 | A -> G | Yes |
| 193 | A -> G | No |
| 235 | T -> C | No |
| 339 | T -> C | No |
| 356 | T -> | No |
| 356 | T -> C | No |
| 417 | A -> T | No |
| 757 | T -> | No |

Variant protein D56406_PEA_1_P5 (SEQ ID NO:1302) according to the present invention has an amino acid sequence as given at the end of the application; it is encoded by transcript(s) D56406_PEA_1_T6 (SEQ ID NO:23). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison Report Between D56406_PEA_1_P5 (SEQ ID NO:1302) and NEUT_HUMAN (SEQ ID NO:1422):

1. An isolated chimeric polypeptide encoding for D56406_PEA_1_P5 (SEQ ID NO:1302) comprising a first amino acid sequence being at least 90% homologous to MMAGMKIQLVCMLLLAFSSWSLC corresponding to amino acids 1-23 of NEUT_HUMAN (SEQ ID NO:1422), which also corresponds to amino acids 1-23 of D56406_PEA_1_P5 (SEQ ID NO:1302), and a second amino acid sequence being at least 90% homologous to SEEEMKALEADFLTNMHTSKISKAH-VPSWKMTLLNVCSLVNNLNSPAEETGEVHEEEL VARRKLPTALDGFSLEAMLTIYQLH-KICHSRAFQHWELIQEDILDTGNDKNGKEEVIKR KIPYILKRQLYENKPRRPYILKRDSYYY corresponding to amino acids 26-170 of NEUT_HUMAN (SEQ ID NO:1422), which also corresponds to amino acids 24-168 of D56406_PEA_1_P5 (SEQ ID NO:1302), wherein said first and second amino acid sequences are contiguous and in a sequential order.

2. An isolated chimeric polypeptide encoding for an edge portion of D56406_PEA_1_P5 (SEQ ID NO:1302), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CS, having a structure as follows: a sequence starting from any of amino acid numbers 23−x to 23; and ending at any of amino acid numbers 24+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P5 (SEQ ID NO:1302) also has the following non-silent SNPs (Single Nucleotide Polymorphisms) as listed in Table 179, (given according to their position(s) on the amino acid sequence, with the alternative amino acid(s) listed; the last column indicates whether the SNP is known or not; the presence of known SNPs in variant protein D56406_PEA_1_P5 (SEQ ID NO:1302) sequence provides support for the deduced sequence of this variant protein according to the present invention).

TABLE 179

Amino acid mutations

| SNP position(s) on amino acid sequence | Alternative amino acid(s) | Previously known SNP? |
|---|---|---|
| 28 | M -> V | No |
| 42 | S -> P | No |

TABLE 179-continued

Amino acid mutations

| SNP position(s) on amino acid sequence | Alternative amino acid(s) | Previously known SNP? |
|---|---|---|
| 82 | V -> | No |
| 82 | V -> A | No |

Variant protein D56406_PEA_1_P5 (SEQ ID NO:1302) is encoded by the following transcript(s): D56406_PEA_1_T6 (SEQ ID NO:23), for which the sequence(s) is/are given at the end of the application. The coding portion of transcript D56406_PEA_1_T6 (SEQ ID NO:23) is shown in bold; this coding portion starts at position 106 and ends at position 609. The transcript also has the following SNPs as listed in Table 180 (given according to their position on the nucleotide sequence, with the alternative nucleic acid listed; the last column indicates whether the SNP is known or not; the presence of known SNPs in variant protein D56406_PEA_1_P5 (SEQ ID NO:1302) sequence provides support for the deduced sequence of this variant protein according to the present invention).

TABLE 180

Nucleic acid SNPs

| SNP position on nucleotide sequence | Alternative nucleic acid | Previously known SNP? |
|---|---|---|
| 94 | G -> T | No |
| 95 | A -> T | No |
| 759 | T -> G | Yes |
| 806 | G -> A | Yes |
| 1014 | T -> G | No |
| 1178 | T -> G | No |
| 103 | A -> G | Yes |
| 187 | A -> G | No |
| 229 | T -> C | No |
| 333 | T -> C | No |
| 350 | T -> | No |
| 350 | T -> C | No |
| 411 | A -> T | No |
| 658 | T -> | No |

Variant protein D56406_PEA_1_P6 (SEQ ID NO:1303) according to the present invention has an amino acid sequence as given at the end of the application; it is encoded by transcript(s) D56406_PEA_1_T7 (SEQ ID NO:24). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison Report Between D56406_PEA_1_P6 (SEQ ID NO:1303) and NEUT_HUMAN (SEQ ID NO:1422):

1. An isolated chimeric polypeptide encoding for D56406_PEA_1_P6 (SEQ ID NO:1303) comprising a first amino acid sequence being at least 90% homologous to MMAGMKIQLVCMLLLAFSSWSLCSD-SEEEMKALEADFLTNMHTSK corresponding to amino acids 1-45 of NEUT_HUMAN (SEQ ID NO:1422), which also corresponds to amino acids 1-45 of D56406_PEA_1_P6 (SEQ ID NO:1303), and a second amino acid sequence being at least 90% homologous to LIQEDILDTGNDKNGKEE-VIKRKIPYILKRQLYENKPRRPYILKRDSYYY corresponding to amino acids 121-170 of NEUT_HUMAN (SEQ ID NO:1422), which also corresponds to amino acids 46-95 of D56406_PEA_1_P6 (SEQ ID NO:1303), wherein said first and second amino acid sequences are contiguous and in a sequential order.

2. An isolated chimeric polypeptide encoding for an edge portion of D56406_PEA_1_P6 (SEQ ID NO:1303), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 45−x to 45; and ending at any of amino acid numbers 46+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P6 (SEQ ID NO:1303) also has the following non-silent SNPs (Single Nucleotide Polymorphisms) as listed in Table 181, (given according to their position(s) on the amino acid sequence, with the alternative amino acid(s) listed; the last column indicates whether the SNP is known or not; the presence of known SNPs in variant protein D56406_PEA_1_P6 (SEQ ID NO:1303) sequence provides support for the deduced sequence of this variant protein according to the present invention).

TABLE 181

Amino acid mutations

| SNP position(s) on amino acid sequence | Alternative amino acid(s) | Previously known SNP? |
|---|---|---|
| 30 | M -> V | No |
| 44 | S -> P | No |

Variant protein D56406_PEA_1_P6 (SEQ ID NO:1303) is encoded by the following transcript(s): D56406_PEA_1_T7 (SEQ ID NO:24), for which the sequence(s) is/are given at the end of the application. The coding portion of transcript D56406_PEA_1_T7 (SEQ ID NO:24) is shown in bold; this coding portion starts at position 106 and ends at position 390. The transcript also has the following SNPs as listed in Table 182 (given according to their position on the nucleotide sequence, with the alternative nucleic acid listed; the last column indicates whether the SNP is known or not; the presence of known SNPs in variant protein D56406_PEA_1_P6 (SEQ ID NO:1303) sequence provides support for the deduced sequence of this variant protein according to the present invention).

TABLE 182

Nucleic acid SNPs

| SNP position on nucleotide sequence | Alternative nucleic acid | Previously known SNP? |
|---|---|---|
| 94 | G -> T | No |
| 95 | A -> T | No |

TABLE 182-continued

Nucleic acid SNPs

| SNP position on nucleotide sequence | Alternative nucleic acid | Previously known SNP? |
|---|---|---|
| 103 | A -> G | Yes |
| 193 | A -> G | No |
| 235 | T -> C | No |
| 439 | T -> | No |
| 540 | T -> G | Yes |
| 587 | G -> A | Yes |
| 795 | T -> G | No |
| 959 | T -> G | No |

As noted above, cluster D56406 features 10 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster D56406_PEA_1_node_0 (SEQ ID NO:1135) according to the present invention is supported by 48 libraries. The number of libraries was determined as previously described. This segment can be found in the following transcript(s): D56406_PEA_1_T3 (SEQ ID NO:22), D56406_PEA_1_T6 (SEQ ID NO:23) and D56406_PEA_1_T7 (SEQ ID NO:24). Table 183 below describes the starting and ending position of this segment on each transcript.

TABLE 183

Segment location on transcripts

| Transcript name | Segment starting position | Segment ending position |
|---|---|---|
| D56406_PEA_1_T3 (SEQ ID NO: 22) | 1 | 178 |
| D56406_PEA_1_T6 (SEQ ID NO: 23) | 1 | 178 |
| D56406_PEA_1_T7 (SEQ ID NO: 24) | 1 | 178 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to lung cancer), shown in Table 184.

TABLE 184

Oligonucleotides related to this segment

| Oligonucleotide name | Overexpressed in cancers | Chip reference |
|---|---|---|
| D56406_0_5_0 | lung malignant tumors | LUN |

Segment cluster D56406_PEA_1_node_13 (SEQ ID NO:1136) according to the present invention is supported by 43 libraries. The number of libraries was determined as previously described. This segment can be found in the following transcript(s): D56406_PEA_1_T3 (SEQ ID NO:22), D56406_PEA_1_T6 (SEQ ID NO:23) and D56406_PEA_1_T7 (SEQ ID NO:24). Table 185 below describes the starting and ending position of this segment on each transcript.

TABLE 185

Segment location on transcripts

| Transcript name | Segment starting position | Segment ending position |
|---|---|---|
| D56406_PEA_1_T3 (SEQ ID NO: 22) | 559 | 902 |
| D56406_PEA_1_T6 (SEQ ID NO: 23) | 460 | 1239 |
| D56406_PEA_1_T7 (SEQ ID NO: 24) | 241 | 1020 |

According to an optional embodiment of the present invention, short segments related to the above cluster are also provided. These segments are up to about 120 bp in length, and so are included in a separate description.

Segment cluster D56406_PEA_1_node_11 (SEQ ID NO:1137) according to the present invention is supported by 1 libraries. The number of libraries was determined as previously described. This segment can be found in the following transcript(s): D56406_PEA_1_T3 (SEQ ID NO:22). Table 186 below describes the starting and ending position of this segment on each transcript.

TABLE 186

Segment location on transcripts

| Transcript name | Segment starting position | Segment ending position |
|---|---|---|
| D56406_PEA_1_T3 (SEQ ID NO: 22) | 466 | 558 |

Segment cluster D56406_PEA_1_node_2 (SEQ ID NO:1138) according to the present invention can be found in the following transcript(s): D56406_PEA_1_T3 (SEQ ID NO:22) and D56406_PEA_1_T7 (SEQ ID NO:24). Table 187 below describes the starting and ending position of this segment on each transcript.

TABLE 187

Segment location on transcripts

| Transcript name | Segment starting position | Segment ending position |
|---|---|---|
| D56406_PEA_1_T3 (SEQ ID NO: 22) | 179 | 184 |
| D56406_PEA_1_T7 (SEQ ID NO: 24) | 179 | 184 |

Segment cluster D56406_PEA_1_node_3 (SEQ ID NO:1139) according to the present invention is supported by 46 libraries. The number of libraries was determined as previously described. This segment can be found in the following transcript(s): D56406_PEA_1_T3 (SEQ ID NO:22), D56406_PEA_1_T6 (SEQ ID NO:23) and D56406_PEA_1_T7 (SEQ ID NO:24). Table 188 below describes the starting and ending position of this segment on each transcript.

TABLE 188

Segment location on transcripts

| Transcript name | Segment starting position | Segment ending position |
|---|---|---|
| D56406_PEA_1_T3 (SEQ ID NO: 22) | 185 | 240 |
| D56406_PEA_1_T6 (SEQ ID NO: 23) | 179 | 234 |
| D56406_PEA_1_T7 (SEQ ID NO: 24) | 185 | 240 |

Segment cluster D56406_PEA_1_node_5 (SEQ ID NO:1140) according to the present invention is supported by 48 libraries. The number of libraries was determined as previously described. This segment can be found in the following transcript(s): D56406_PEA_1_T3 (SEQ ID NO:22) and D56406_PEA_1_T6 (SEQ ID NO:23). Table 189 below describes the starting and ending position of this segment on each transcript.

TABLE 189

Segment location on transcripts

| Transcript name | Segment starting position | Segment ending position |
|---|---|---|
| D56406_PEA_1_T3 (SEQ ID NO: 22) | 241 | 355 |
| D56406_PEA_1_T6 (SEQ ID NO: 23) | 235 | 349 |

Segment cluster D56406_PEA_1_node_6 (SEQ ID NO:1141) according to the present invention is supported by 34 libraries. The number of libraries was determined as previously described. This segment can be found in the following transcript(s): D56406_PEA_1_T3 (SEQ ID NO:22) and D56406_PEA_1_T6 (SEQ ID NO:23). Table 190 below describes the starting and ending position of this segment on each transcript.

TABLE 190

Segment location on transcripts

| Transcript name | Segment starting position | Segment ending position |
|---|---|---|
| D56406_PEA_1_T3 (SEQ ID NO: 22) | 356 | 389 |
| D56406_PEA_1_T6 (SEQ ID NO: 23) | 350 | 383 |

Segment cluster D56406_PEA_1_node_7 (SEQ ID NO:1142) according to the present invention is supported by 32 libraries. The number of libraries was determined as previously described. This segment can be found in the following transcript(s): D56406_PEA_1_T3 (SEQ ID NO:22) and D56406_PEA_1_T6 (SEQ ID NO:23). Table 191 below describes the starting and ending position of this segment on each transcript.

TABLE 191

Segment location on transcripts

| Transcript name | Segment starting position | Segment ending position |
|---|---|---|
| D56406_PEA_1_T3 (SEQ ID NO: 22) | 390 | 415 |
| D56406_PEA_1_T6 (SEQ ID NO: 23) | 384 | 409 |

Segment cluster D56406_PEA_1_node_8 (SEQ ID NO:1143) according to the present invention can be found in the following transcript(s): D56406_PEA_1_T3 (SEQ ID NO:22) and D56406_PEA_1_T6 (SEQ ID NO:23). Table 192 below describes the starting and ending position of this segment on each transcript.

TABLE 192

Segment location on transcripts

| Transcript name | Segment starting position | Segment ending position |
|---|---|---|
| D56406_PEA_1_T3 (SEQ ID NO: 22) | 416 | 423 |
| D56406_PEA_1_T6 (SEQ ID NO: 23) | 410 | 417 |

Segment cluster D56406_PEA_1_node_9 (SEQ ID NO:1144) according to the present invention is supported by 31 libraries. The number of libraries was determined as previously described. This segment can be found in the following transcript(s): D56406_PEA_1_T3 (SEQ ID NO:22) and D56406_PEA_1_T6 (SEQ ID NO:23). Table 193 below describes the starting and ending position of this segment on each transcript.

TABLE 193

Segment location on transcripts

| Transcript name | Segment starting position | Segment ending position |
|---|---|---|
| D56406_PEA_1_T3 (SEQ ID NO: 22) | 424 | 465 |
| D56406_PEA_1_T6 (SEQ ID NO: 23) | 418 | 459 |

Variant Protein Alignment to the Previously Known Protein:
Sequence name: /tmp/jU49325aMA/8FOXuN7La5:NEUT_HUMAN (SEQ ID NO:1422)

Sequence documentation:

Alignment of: D56406_PEA_1_P2 (SEQ ID NO:1301) x NEUT_HUMAN (SEQ ID NO:1422) ..
Alignment segment 1/1:

| | | | |
|---|---|---|---|
| Quality: | 1591.00 | Escore: | 0 |
| Matching length: | 170 | Total length: | 201 |
| Matching Percent Similarity: | 100.00 | Matching Percent Identity: | 100.00 |
| Total Percent Similarity: | 84.58 | Total Percent Identity: | 84.58 |
| Gaps: | 1 | | |

Alignment:

```
  1  MMAGMKIQLVCMLLLAFSSWSLCSDSEEEMKALEADFLTNMHTSKISKAH   50
     ||||||||||||||||||||||||||||||||||||||||||||||||||
  1  MMAGMKIQLVCMLLLAFSSWSLCSDSEEEMKALEADFLTNMHTSKISKAH   50

51  VPSWKMTLLNVCSLVNNLNSPAEETGEVHEEELVARRKLPTALDGFSLEA  100
     ||||||||||||||||||||||||||||||||||||||||||||||||||
 51  VPSWKMTLLNVCSLVNNLNSPAEETGEVHEEELVARRKLPTALDGFSLEA  100

101  MLTIYQLHKICHSRAFQHWEARWLTPVIPALWEAETGGSRGQEMETIPAN  150
     |||||||||||||||||||
101  MLTIYQLHKICHSRAFQHWE                               120

151  TLIQEDILDTGNDKNGKEEVIKRKIPYILKRQLYENKPRRPYILKRDSYY  200
      |||||||||||||||||||||||||||||||||||||||||||||||||
121  .LIQEDILDTGNDKNGKEEVIKRKIPYILKRQLYENKPRRPYILKRDSYY  169

201  Y                                                  201
     |
170  Y                                                  170
```

Sequence name: /tmp/wWui8_Kd4y9/zbf3ihRwnR:NEUT_HUMAN (SEQ ID NO:1422)

Sequence documentation:

Alignment of: D56406_PEA_1_P5 (SEQ ID NO:1302) x NEUT_HUMAN (SEQ ID NO:1422) ..

Alignment segment 1/1:

| | | | |
|---|---|---|---|
| Quality: | 1572.00 | Escore: | 0 |
| Matching length: | 168 | Total length: | 170 |
| Matching Percent Similarity: | 100.00 | Matching Percent Identity: | 100.00 |
| Total Percent Similarity: | 98.82 | Total Percent Identity: | 98.82 |
| Gaps: | 1 | | |

Alignment:

```
  1 MMAGMKIQLVCMLLLAFSSWSLC..SEEEMKALEADFLTNMHTSKISKAH    48
    ||||||||||||||||||||||  ||||||||||||||||||||||||||
  1 MMAGMKIQLVCMLLLAFSSWSLCSDSEEEMKALEADFLTNMHTSKISKAH    50

49 VPSWKMTLLNVCSLVNNLNSPAEETGEVHEEELVARRKLPTALDGFSLEA    98
    ||||||||||||||||||||||||||||||||||||||||||||||||||
 51 VPSWKMTLLNVCSLVNNLNSPAEETGEVHEEELVARRKLPTALDGFSLEA   100

99 MLTIYQLHKICHSRAFQHWELTQEDILDTGNDKNGKEEVIKRKIPYILKR   148
    |||||||||||||||||||||:||||||||||||||||||||||||||||
101 MLTIYQLHKICHSRAFQHWELIQEDILDTGNDKNGKEEVIKRKIPYILKR   150

149 QLYENKPRRPYILKRDSYYY                                 168
    ||||||||||||||||||||
151 QLYENKPRRPYILKRDSYYY                                 170
```

Sequence name: /tmp/f5d07fF5D7/E4N5xjUIAN:NEUT_HUMAN (SEQ ID NO:1422)
Sequence documentation:
Alignment of: D56406_PEA_1_P6 (SEQ ID NO:1303) x NEUT_HUMAN (SEQ ID NO:1422) ..
Alignment segment 1/1:

| | | | |
|---|---|---|---|
| Quality: | 844.00 | Escore: | 0 |
| Matching length: | 95 | Total length: | 170 |
| Matching Percent Similarity: | 100.00 | Matching Percent Identity: | 100.00 |
| Total Percent Similarity: | 55.88 | Total Percent Identity: | 55.88 |
| Gaps: | 1 | | |

Alignment:

```
  1  MMAGMKIQLVCMLLLAFSSWSLCSDSEEEMKALEADFLTNMHTSK.....   45
     ||||||||||||||||||||||||||||||||||||||||||||
  1  MMAGMKIQLVCMLLLAFSSWSLCSDSEEEMKALEADFLTNMHTSKISKAH   50

45  ..................................................  45
 51  VPSWKMTLLNVCSLVNNLNSPAEETGEVHEEELVARRKLPTALDGFSLEA  100

46  ....................LIQEDILDTGNDKNGKEEVIKRKIPYILKR   75
                         ||||||||||||||||||||||||||||||
101  MLTIYQLHKICHSRAFQHWELIQEDILDTGNDKNGKEEVIKRKIPYILKR  150

76  QLYENKPRRPYILKRDSYYY                                 95
     ||||||||||||||||||||
151  QLYENKPRRPYILKRDSYYY                                170
```

Description for Cluster F05068

Cluster F05068 features 3 transcript(s) and 12 segment(s) of interest, the names for which are given in Tables 194 and 195, respectively, the sequences themselves are given at the end of the application. The selected protein variants are given in table 196.

TABLE 194

| Transcripts of interest | |
|---|---|
| Transcript Name | Sequence ID No. |
| F05068_PEA_1_T3 | 25 |
| F05068_PEA_1_T4 | 26 |
| F05068_PEA_1_T6 | 27 |

```
  1 MKYSCCALVLAVLGTELLGSLCSTVRSPRFRGRIQQERKNIRPNIILVLT    50
    ||||||||||||||||||||||||||||||||||||||||||||||||||
  1 MKYSCCALVLAVLGTELLGSLCSTVRSPRFRGRIQQERKNIRPNIILVLT    50

51 DDQDVELA..........................................    58
    ||||||||
 51 DDQDVELGSLQVMNKTRKIMEHGGATFINAFVTTPMCCPSRSSMLTGKYV   100

59 ........................................FFGKYLNEYNGS  70
                                             ||||||||||||
101 HNHNVYTNNENCSSPSWQAMHEPRTEAVYLNNTGYRTVFFGKYLNEYNGS   150

71 YIPPGWREWLGLIKNSRFYNYTVCRNGIKEKHGFDYAKDYFTDLITNESI   120
    |||||||||||| ||||||||||||||||||||||||||||||||||||
151 YIPPGWREWLGLTKNSRFYNYTVCRNGIKEKHGFDYAKDYFTDLITNESI   200

121 NYFKMSKRMYPHRPVMMVISHAAPHGPEDSAPQFSKLYPNASQHITPSYN   170
    |||||||||||||||||||||||||||||||||||||||||||||||||
201 NYFKMSKRMYPHRPVMMVISHAAPHGPEDSAPQFSKLYPNASQHITPSYN   250

171 YAPNMDKHWIMQYTGPMLPIHMEFTNILQRKRLQTLMSVDDSVERLYNML   220
    |||||||||||||||||||||||||||||||||||||||||||||||||
251 YAPNMDKHWIMQYTGPMLPIHMEFTNILQRKRLQTLMSVDDSVERLYNML   300

221 VETGELENTYIIYTADHGYHIGQFGLVKGKSMPYDFDIRVPFFIRGPSVE   270
    |||||||||||||||||||||||||||||||||||||||||||||||||
301 VETGELENTYIIYTADHGYHIGQFGLVKGKSMPYDFDIRVPFFIRGPSVE   350

271 PGSIVPQIVLNIDLAPTILDIAGLDTPPDVDGKSVLKLLDPEKPGNRFRT   320
    |||||||||||||||||||||||||||||||||||||||||||||||||
351 PGSIVPQIVLNIDLAPTILDIAGLDTPPDVDGKSVLKLLDPEKPGNRFRT   400

321 NKKAKIWRDTFLVERGKFLRKKEESSKNIQQSNHLPKYERVKELCQQARY   370
    |||||||||||||||||||||||||||||||||||||||||||||||||
401 NKKAKIWRDTFLVERGKFLRKKEESSKNIQQSNHLPKYERVKELCQQARY   450

371 QTACEQPGQKWQCIEDTSGKLRIHKCKGPSDLLTVRQSTRNLYARGFRDK   420
    |||||||||||||||||||||||||||||||||||||||||||||| ||
451 QTACEQPGQKWQCIEDTSGKLRIHKCKGPSDLLTVRQSTRNLYARGFHDK   500

421 DKECSCRESGYRASRSQRKSQRQFLRNQGTPKYKPRFVHTRQTRSLSVEF   470
    |||||||||||||||||||||||||||||||||||||||||||||||||
501 DKECSCRESGYRASRSQRKSQRQFLRNQGTPKYKPRFVHTRQTRSLSVEF   550

471 EGEIYDINLEEEEELQVLQPRNIAKRHDEGHKGPRDLQASSGGNRGRMLA   520
    |||||||||||||||||||||||||||||||||||||||||||||||||
551 EGEIYDINLEEEEELQVLQPRNIAKRHDEGHKGPRDLQASSGGNRGRMLA   600

521 DSSNAVGPPTTVRVTRKCFILPNDSIHCERELYQSARAWKDHKAYIDKEI   570
    ||||||||||||||| |||||||||||||||||||||||||||||||||
601 DSSNAVGPPTTVRVTHKCFILPNDSIHCERELYQSARAWKDHKAYIDKEI   650

571 EALQDKIKNLREVRGHLKRRKPEECSCSKQSYYNKEKGVKKQEKLKSHLH   620
    |||||||||||||||||||||||||||||||||||||||||||||||||
651 EALQDKIKNLREVRGHLKRRKPEECSCSKQSYYNKEKGVKKQEKLKSHLH   700

621 PFKEAAQEVDSKLQLFKENNRRRKKERKEKRRQRKGEECSLPGLTCFTHD   670
    |||||||||||||||||||||||||||||||||||||||||||||||||
701 PFKEAAQEVDSKLQLFKENNRRRKKERKEKRRQRKGEECSLPGLTCFTHD   750

671 NNHWQTAPFWNLGSFCACTSSNNNTYWCLRTVNETHNFLFCEFATGFLEY   720
    |||||||||||||||||||||||||||||||||||||||||||||||||
751 NNHWQTAPFWNLGSFCACTSSNNNTYWCLRTVNETHNFLFCEFATGFLEY   800

721 FDMNTDPYQLTNTVHTVERGILNQLHVQLMELRSCQGYKQCNPRPKNLDV   770
    |||||||||||||||||||||||||||||||||||||||||||||||||
801 FDMNTDPYQLTNTVHTVERGILNQLHVQLMELRSCQGYKQCNPRPKNLDV   850

771 GNKDGGSYDLHRGQLWDGWEG                               791
    |||||||||||||||||||||
851 GNKDGGSYDLHRGQLWDGWEG                               871
```

TABLE 196

Proteins of interest

| Protein Name | Sequence ID No. |
|---|---|
| F05068_PEA_1_P7 | 1304 |
| F05068_PEA_1_P8 | 1305 |

These sequences are variants of the known protein ADM precursor [Contains: Adrenomedullin (AM); Proadrenomedullin N-20 terminal peptide (ProAM-N20) (ProAM N-terminal 20 peptide) (PAMP)] (SwissProt accession identifier ADML_HUMAN), SEQ ID NO:1423, referred to herein as the previously known protein.

Protein ADM precursor is known or believed to have the following function(s): AM and PAMP are potent hypotensive and vasodilatator agents. Numerous actions have been reported, most related to the physiologic control of fluid and electrolyte homeostasis. In the kidney, AM is diuretic and natriuretic, and both AM and PAMP inhibit aldosterone secretion by direct adrenal actions. In pituitary gland, both peptides at physiologically relevant doses inhibit basal ACTH secretion. Both peptides appear to act in brain and pituitary gland to facilitate the loss of plasma volume, actions which complement their hypotensive effects in blood vessels. The sequence for protein ADM precursor is given at the end of the application, as "ADM precursor [Contains: Adrenomedullin (AM); Proadrenomedullin N-20 terminal peptide (ProAM-N20) (ProAM N-terminal 20 peptide) (PAMP)] amino acid sequence". Known polymorphisms for this sequence are as shown in Table 197.

TABLE 197

Amino acid mutations for Known Protein

| SNP position(s) on amino acid sequence | Comment |
|---|---|
| 50 | S -> R (in dbSNP: 5005). /FTId = VAR_014861. |

Protein ADM precursor localization is believed to be Secreted.

The following GO Annotation(s) apply to the previously known protein. The following annotation(s) were found: cAMP biosynthesis; progesterone biosynthesis; signal transduction; cell-cell signaling; pregnancy; excretion; circulation; response to wounding, which are annotation(s) related to Biological Process; ligand; hormone, which are annotation(s) related to Molecular Function; and extracellular space; soluble fraction, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster F05068 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 21 refer to weighted expression of ESTs in each category, as "parts per million" (ratio of the expression of ESTs for a particular cluster to the expression of all ESTs in that category, according to parts per million).

Figure 21:
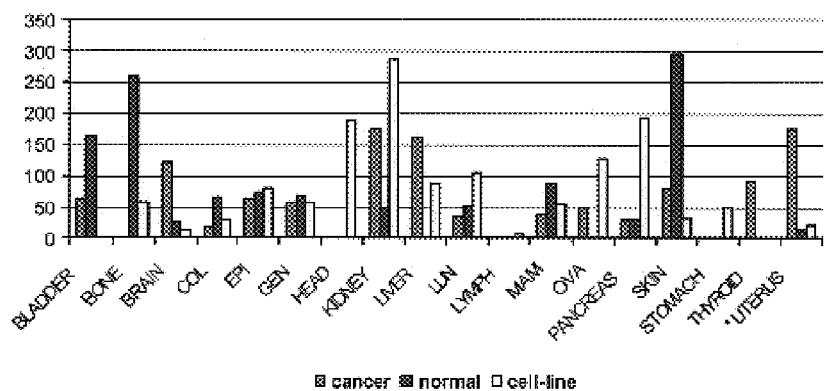
FIG. 21 is a histogram showing Cancer and cell-line vs. normal tissue expression for Cluster F05068, demonstrating overexpression in uterine malignancies.

Overall, the following results were obtained as shown with regard to the histograms in FIG. 21 and Table 198. This cluster is overexpressed (at least at a minimum level) in the following pathological conditions: uterine malignancies.

TABLE 198

Normal tissue distribution

| Name of Tissue | Number |
|---|---|
| bladder | 164 |
| bone | 259 |
| brain | 26 |
| colon | 66 |
| epithelial | 73 |
| general | 67 |
| head and neck | 0 |
| kidney | 49 |
| liver | 0 |
| lung | 51 |
| lymph nodes | 0 |
| breast | 87 |
| ovary | 0 |
| pancreas | 30 |
| skin | 295 |
| stomach | 0 |
| Thyroid | 0 |
| uterus | 13 |

TABLE 199

P values and ratios for expression in cancerous tissue

| Name of Tissue | P1 | P2 | SP1 | R3 | SP2 | R4 |
|---|---|---|---|---|---|---|
| bladder | 7.6e−01 | 8.0e−01 | 9.4e−01 | 0.5 | 9.9e−01 | 0.4 |
| bone | 7.5e−01 | 8.8e−01 | 1 | 0.1 | 1 | 0.3 |
| brain | 5.2e−01 | 6.1e−01 | 7.0e−04 | 2.1 | 1.1e−02 | 1.4 |
| colon | 6.2e−01 | 6.1e−01 | 9.7e−01 | 0.5 | 9.6e−01 | 0.6 |
| epithelial | 1.0e−01 | 3.0e−02 | 7.8e−01 | 0.7 | 5.8e−01 | 0.9 |
| general | 3.7e−01 | 2.6e−01 | 8.5e−01 | 0.8 | 9.0e−01 | 0.8 |
| head and neck | 2.1e−01 | 1.1e−01 | 1 | 1.0 | 3.2e−01 | 2.3 |
| kidney | 3.8e−01 | 3.9e−01 | 6.6e−02 | 1.8 | 1.2e−02 | 2.2 |
| liver | 1.8e−01 | 1.2e−01 | 2.3e−01 | 4.3 | 2.3e−01 | 2.6 |
| lung | 6.2e−01 | 4.3e−01 | 8.5e−01 | 0.7 | 3.8e−01 | 1.0 |
| lymph nodes | 1 | 3.1e−01 | 1 | 1.0 | 1 | 1.3 |
| breast | 7.8e−01 | 5.8e−01 | 9.1e−01 | 0.6 | 8.9e−01 | 0.7 |
| ovary | 3.8e−01 | 2.6e−01 | 3.2e−01 | 2.4 | 1.6e−01 | 2.5 |
| pancreas | 5.1e−01 | 3.3e−01 | 7.0e−01 | 0.9 | 1.0e−01 | 1.4 |
| skin | 6.0e−01 | 5.2e−01 | 9.7e−01 | 0.3 | 1 | 0.1 |
| stomach | 3.6e−01 | 3.0e−01 | 1 | 1.0 | 4.1e−01 | 1.8 |
| Thyroid | 5.0e−01 | 5.0e−01 | 6.7e−01 | 1.7 | 6.7e−01 | 1.7 |
| uterus | 1.1e−01 | 2.6e−01 | 2.1e−03 | 3.2 | 2.3e−02 | 2.2 |

As noted above, cluster F05068 features 3 transcript(s), which were listed in Table 194 above. These transcript(s) encode for protein(s) which are variant(s) of protein ADM precursor. A description of each variant protein according to the present invention is now provided.

Variant protein F05068_PEA_1_P7 (SEQ ID NO:1304) according to the present invention has an amino acid sequence as given at the end of the application; it is encoded by transcript(s) F05068_PEA_1_T3 (SEQ ID NO:25) and F05068_PEA_1_T6 (SEQ ID NO:27). An alignment is given to the known protein (ADM precursor) at the end of the application. One or more alignments to one or more previously published protein sequences are given at the end of the application. A brief description of the relationship of the variant protein according to the present invention to each such aligned protein is as follows:

Comparison Report Between F05068_PEA_1_P7 (SEQ ID NO:1304) and ADML_HUMAN (SEQ ID NO:1423):

1. An isolated chimeric polypeptide encoding for F05068_PEA_1_P7 (SEQ ID NO:1304), comprising a first amino acid sequence being at least 90% homologous to MKLVSVALMYLGSLAFLGADTARLDVASEFRKK corresponding to amino acids 1-33 of ADML_HUMAN (SEQ ID NO:1423), which also corresponds to amino acids 1-33 of F05068_PEA_1_P7 (SEQ ID NO:1304).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein F05068_PEA_1_P7 (SEQ ID NO:1304) also has the following non-silent SNPs (Single Nucleotide Polymorphisms) as listed in Table 200, (given according to their position(s) on the amino acid sequence, with the alternative amino acid(s) listed; the last column indicates whether the SNP is known or not; the presence of known SNPs in variant protein F05068_PEA_1_P7 (SEQ ID NO:1304) sequence provides support for the deduced sequence of this variant protein according to the present invention).

TABLE 200

Amino acid mutations

| SNP position(s) on amino acid sequence | Alternative amino acid(s) | Previously known SNP? |
| --- | --- | --- |
| 4 | V -> F | No |
| 10 | Y -> C | No |

Variant protein F05068_PEA_1_P7 (SEQ ID NO:1304) is encoded by the following transcript(s): F05068_PEA_1_T3 (SEQ ID NO:25) and F05068_PEA_1_T6 (SEQ ID NO:27), for which the sequence(s) is/are given at the end of the application.

The coding portion of transcript F05068_PEA_1_T3 (SEQ ID NO:25) is shown in bold; this coding portion starts at position 267 and ends at position 365. The transcript also has the following SNPs as listed in Table 201 (given according to their position on the nucleotide sequence, with the alternative nucleic acid listed; the last column indicates whether the SNP is known or not; the presence of known SNPs in variant protein F05068_PEA_1_P7 (SEQ ID NO:1304) sequence provides support for the deduced sequence of this variant protein according to the present invention).

TABLE 201

Nucleic acid SNPs

| SNP position on nucleotide sequence | Alternative nucleic acid | Previously known SNP? |
| --- | --- | --- |
| 26 | C -> T | Yes |
| 164 | T -> | No |
| 593 | G -> C | Yes |
| 860 | C -> | No |
| 860 | C -> A | No |
| 1022 | G -> A | No |
| 1023 | G -> A | No |
| 1023 | G -> C | Yes |

TABLE 201-continued

Nucleic acid SNPs

| SNP position on nucleotide sequence | Alternative nucleic acid | Previously known SNP? |
| --- | --- | --- |
| 1084 | G -> A | Yes |
| 1088 | C -> | No |
| 1088 | C -> A | No |
| 1106 | C -> | No |
| 177 | T -> | No |
| 1106 | C -> A | No |
| 1149 | G -> | No |
| 1154 | C -> | No |
| 1171 | T -> G | Yes |
| 1192 | G -> | No |
| 1224 | C -> | No |
| 1266 | C -> | No |
| 1282 | C -> T | No |
| 1381 | G -> A | No |
| 1450 | T -> | No |
| 206 | C -> T | Yes |
| 1457 | T -> G | No |
| 1534 | C -> | No |
| 1535 | C -> | No |
| 1554 | A -> G | Yes |
| 1572 | A -> C | No |
| 1572 | A -> G | No |
| 1655 | A -> C | Yes |
| 1669 | T -> C | Yes |
| 1721 | C -> T | No |
| 245 | G -> | No |
| 259 | C -> | No |
| 276 | G -> T | No |
| 295 | A -> G | No |
| 317 | A -> C | Yes |
| 566 | C -> G | Yes |

The coding portion of transcript F05068_PEA_1_T6 (SEQ ID NO:27) is shown in bold; this coding portion starts at position 267 and ends at position 365. The transcript also has the following SNPs as listed in Table 202 (given according to their position on the nucleotide sequence, with the alternative nucleic acid listed; the last column indicates whether the SNP is known or not; the presence of known SNPs in variant protein F05068_PEA_1_P7 (SEQ ID NO:1304) sequence provides support for the deduced sequence of this variant protein according to the present invention).

TABLE 202

Nucleic acid SNPs

| SNP position on nucleotide sequence | Alternative nucleic acid | Previously known SNP? |
| --- | --- | --- |
| 26 | C -> T | Yes |
| 164 | T -> | No |
| 593 | G -> C | Yes |
| 739 | C -> G | Yes |
| 1093 | C -> | No |
| 1093 | C -> A | No |
| 1255 | G -> A | No |
| 1256 | G -> A | No |
| 1256 | G -> C | Yes |
| 1317 | G -> A | Yes |
| 1321 | C -> | No |
| 1321 | C -> A | No |
| 177 | T -> | No |
| 1339 | C -> | No |
| 1339 | C -> A | No |
| 1382 | G -> | No |
| 1387 | C -> | No |
| 1404 | T -> G | Yes |
| 1425 | G -> | No |

TABLE 202-continued

Nucleic acid SNPs

| SNP position on nucleotide sequence | Alternative nucleic acid | Previously known SNP? |
|---|---|---|
| 1457 | C -> | No |
| 1499 | C -> | No |
| 1515 | C -> T | No |
| 1614 | G -> A | No |
| 206 | C -> T | Yes |
| 1683 | T -> | No |
| 1690 | T -> G | No |
| 1767 | C -> | No |
| 1768 | C -> | No |
| 1787 | A -> G | Yes |
| 1805 | A -> C | No |
| 1805 | A -> G | No |
| 1888 | A -> C | Yes |
| 1902 | T -> C | Yes |
| 1954 | C -> T | No |
| 245 | G -> | No |
| 259 | C -> | No |
| 276 | G -> T | No |
| 295 | A -> G | No |
| 317 | A -> C | Yes |
| 566 | C -> G | Yes |

Variant protein F05068_PEA_1_P8 (SEQ ID NO:1305) according to the present invention has an amino acid sequence as given at the end of the application; it is encoded by transcript(s) F05068_PEA_1_T4 (SEQ ID NO:26). An alignment is given to the known protein (ADM precursor) at the end of the application. One or more alignments to one or more previously published protein sequences are given at the end of the application. A brief description of the relationship of the variant protein according to the present invention to each such aligned protein is as follows:

Comparison Report Between F05068_PEA_1_P8 (SEQ ID NO:1305) and ADML_HUMAN (SEQ ID NO:1423):

1. An isolated chimeric polypeptide encoding for F05068_PEA_1_P8 (SEQ ID NO:1305), comprising a first amino acid sequence being at least 90% homologous to MKLVSVALMYLGSLAFLGADTARLD-VASEFRKKWNKWALSRGKRELRMSSSYPTGLA DVKAGPAQTLIRPQDMKGASRSPED corresponding to amino acids 1-82 of ADML_HUMAN (SEQ ID NO:1423), which also corresponds to amino acids 1-82 of F05068_PEA_1_P8 (SEQ ID NO:1305), and a second amino acid sequence being at least 70%, optionally at least 80%, preferably at least 85%, more preferably at least 90% and most preferably at least 95% homologous to a polypeptide having the sequence R corresponding to amino acids 83-83 of F05068_PEA_1_P8 (SEQ ID NO:1305), wherein said first and second amino acid sequences are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein F05068_PEA_1_P8 (SEQ ID NO:1305) also has the following non-silent SNPs (Single Nucleotide Polymorphisms) as listed in Table 203, (given according to their position(s) on the amino acid sequence, with the alternative amino acid(s) listed; the last column indicates whether the SNP is known or not; the presence of known SNPs in variant protein F05068_PEA_1_P8 (SEQ ID NO:1305) sequence provides support for the deduced sequence of this variant protein according to the present invention).

TABLE 203

Amino acid mutations

| SNP position(s) on amino acid sequence | Alternative amino acid(s) | Previously known SNP? |
|---|---|---|
| 4 | V -> F | No |
| 50 | S -> R | Yes |
| 10 | Y -> C | No |

Variant protein F05068_PEA_1_P8 (SEQ ID NO:1305) is encoded by the following transcript(s): F05068_PEA_1_T4 (SEQ ID NO:26), for which the sequence(s) is/are given at the end of the application. The coding portion of transcript F05068_PEA_1_T4 (SEQ ID NO:26) is shown in bold; this coding portion starts at position 267 and ends at position 515. The transcript also has the following SNPs as listed in Table 204 (given according to their position on the nucleotide sequence, with the alternative nucleic acid listed; the last column indicates whether the SNP is known or not; the presence of known SNPs in variant protein F05068_PEA_1_P8 (SEQ ID NO:1305) sequence provides support for the deduced sequence of this variant protein according to the present invention).

TABLE 204

Nucleic acid SNPs

| SNP position on nucleotide sequence | Alternative nucleic acid | Previously known SNP? |
|---|---|---|
| 26 | C -> T | Yes |
| 164 | T -> | No |
| 443 | G -> C | Yes |
| 589 | C -> G | Yes |
| 943 | C -> | No |
| 943 | C -> A | No |
| 1105 | G -> A | No |
| 1106 | G -> A | No |
| 1106 | G -> C | Yes |
| 1167 | G -> A | Yes |
| 1171 | C -> | No |
| 1171 | C -> A | No |
| 177 | T -> | No |
| 1189 | C -> | No |
| 1189 | C -> A | No |
| 1232 | G -> | No |
| 1237 | C -> | No |
| 1254 | T -> G | Yes |
| 1275 | G -> | No |
| 1307 | C -> | No |
| 1349 | C -> | No |
| 1365 | C -> T | No |
| 1464 | G -> A | No |
| 206 | C -> T | Yes |
| 1533 | T -> | No |
| 1540 | T -> G | No |
| 1617 | C -> | No |
| 1618 | C -> | No |
| 1637 | A -> G | Yes |
| 1655 | A -> C | No |
| 1655 | A -> G | No |
| 1738 | A -> C | Yes |
| 1752 | T -> C | Yes |
| 1804 | C -> T | No |
| 245 | G -> | No |
| 259 | C -> | No |
| 276 | G -> T | No |

TABLE 204-continued

Nucleic acid SNPs

| SNP position on nucleotide sequence | Alternative nucleic acid | Previously known SNP? |
|---|---|---|
| 295 | A -> G | No |
| 317 | A -> C | Yes |
| 416 | C -> G | Yes |

As noted above, cluster F05068 features 12 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster F05068_PEA_1_node_0 (SEQ ID NO:1145) according to the present invention is supported by 143 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27).

TABLE 205

Segment location on transcripts

| Transcript name | Segment starting position | Segment ending position |
|---|---|---|
| F05068_PEA_1_T3 (SEQ ID NO: 25) | 1 | 245 |
| F05068_PEA_1_T4 (SEQ ID NO: 26) | 1 | 245 |
| F05068_PEA_1_T6 (SEQ ID NO: 27) | 1 | 245 |

Segment cluster F05068_PEA_1_node_10 (SEQ ID NO:1146) according to the present invention is supported by 127 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 206 below describes the starting and ending position of this segment on each transcript.

TABLE 206

Segment location on transcripts

| Transcript name | Segment starting position | Segment ending position |
|---|---|---|
| F05068_PEA_1_T3 (SEQ ID NO: 25) | 749 | 909 |
| F05068_PEA_1_T4 (SEQ ID NO: 26) | 832 | 992 |
| F05068_PEA_1_T6 (SEQ ID NO: 27) | 982 | 1142 |

Segment cluster F05068_PEA_1_node_12 (SEQ ID NO:1147) according to the present invention is supported by 123 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 207 below describes the starting and ending position of this segment on each transcript.

TABLE 207

Segment location on transcripts

| Transcript name | Segment starting position | Segment ending position |
|---|---|---|
| F05068_PEA_1_T3 (SEQ ID NO: 25) | 986 | 1106 |
| F05068_PEA_1_T4 (SEQ ID NO: 26) | 1069 | 1189 |
| F05068_PEA_1_T6 (SEQ ID NO: 27) | 1219 | 1339 |

Segment cluster F05068_PEA_1_node_13 (SEQ ID NO:1148) according to the present invention is supported by 181 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 208 below describes the starting and ending position of this segment on each transcript.

TABLE 208

Segment location on transcripts

| Transcript name | Segment starting position | Segment ending position |
|---|---|---|
| F05068_PEA_1_T3 (SEQ ID NO: 25) | 1107 | 1737 |
| F05068_PEA_1_T4 (SEQ ID NO: 26) | 1190 | 1820 |
| F05068_PEA_1_T6 (SEQ ID NO: 27) | 1340 | 1970 |

Segment cluster F05068_PEA_1_node_4 (SEQ ID NO:1149) according to the present invention is supported by 15 libraries. The number of libraries was determined as previously described. This segment can be found in the following transcript(s): F05068_PEA_1_T3 (SEQ ID NO:25) and F05068_PEA_1_T6 (SEQ ID NO:27). Table 209 below describes the starting and ending position of this segment on each transcript.

TABLE 209

Segment location on transcripts

| Transcript name | Segment starting position | Segment ending position |
|---|---|---|
| F05068_PEA_1_T3 (SEQ ID NO: 25) | 365 | 514 |
| F05068_PEA_1_T6 (SEQ ID NO: 27) | 365 | 514 |

Segment cluster F05068_PEA_1_node_8 (SEQ ID NO:1150) according to the present invention is supported by 13 libraries. The number of libraries was determined as previously described. This segment can be found in the following transcript(s): F05068_PEA_1_T4 (SEQ ID NO:26) and F05068_PEA_1_T6 (SEQ ID NO:27). Table 210 below describes the starting and ending position of this segment on each transcript.

TABLE 210

Segment location on transcripts

| Transcript name | Segment starting position | Segment ending position |
|---|---|---|
| F05068_PEA_1_T4 (SEQ ID NO: 26) | 515 | 747 |
| F05068_PEA_1_T6 (SEQ ID NO: 27) | 665 | 897 |

According to an optional embodiment of the present invention, short segments related to the above cluster are also provided. These segments are up to about 120 bp in length, and so are included in a separate description.

Segment cluster F05068_PEA_1_node_11 (SEQ ID NO:1151) according to the present invention is supported by 112 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 211 below describes the starting and ending position of this segment on each transcript.

TABLE 211

Segment location on transcripts

| Transcript name | Segment starting position | Segment ending position |
|---|---|---|
| F05068_PEA_1_T3 (SEQ ID NO: 25) | 910 | 985 |
| F05068_PEA_1_T4 (SEQ ID NO: 26) | 993 | 1068 |
| F05068_PEA_1_T6 (SEQ ID NO: 27) | 1143 | 1218 |

Segment cluster F05068_PEA_1_node_3 (SEQ ID NO:1152) according to the present invention is supported by 145 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 212 below describes the starting and ending position of this segment on each transcript.

TABLE 212

Segment location on transcripts

| Transcript name | Segment starting position | Segment ending position |
|---|---|---|
| F05068_PEA_1_T3 (SEQ ID NO: 25) | 246 | 364 |
| F05068_PEA_1_T4 (SEQ ID NO: 26) | 246 | 364 |
| F05068_PEA_1_T6 (SEQ ID NO: 27) | 246 | 364 |

Segment cluster F05068_PEA_1_node_5 (SEQ ID NO:1153) according to the present invention is supported by 124 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 213 below describes the starting and ending position of this segment on each transcript.

TABLE 213

Segment location on transcripts

| Transcript name | Segment starting position | Segment ending position |
|---|---|---|
| F05068_PEA_1_T3 (SEQ ID NO: 25) | 515 | 573 |
| F05068_PEA_1_T4 (SEQ ID NO: 26) | 365 | 423 |
| F05068_PEA_1_T6 (SEQ ID NO: 27) | 515 | 573 |

Segment cluster F05068_PEA_1_node_6 (SEQ ID NO:1154) according to the present invention is supported by 110 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 214 below describes the starting and ending position of this segment on each transcript.

TABLE 214

Segment location on transcripts

| Transcript name | Segment starting position | Segment ending position |
|---|---|---|
| F05068_PEA_1_T3 (SEQ ID NO: 25) | 574 | 613 |
| F05068_PEA_1_T4 (SEQ ID NO: 26) | 424 | 463 |
| F05068_PEA_1_T6 (SEQ ID NO: 27) | 574 | 613 |

Segment cluster F05068_PEA_1_node_7 (SEQ ID NO:1155) according to the present invention is supported by 109 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 215 below describes the starting and ending position of this segment on each transcript.

TABLE 215

Segment location on transcripts

| Transcript name | Segment starting position | Segment ending position |
|---|---|---|
| F05068_PEA_1_T3 (SEQ ID NO: 25) | 614 | 664 |
| F05068_PEA_1_T4 (SEQ ID NO: 26) | 464 | 514 |
| F05068_PEA_1_T6 (SEQ ID NO: 27) | 614 | 664 |

Segment cluster F05068_PEA_1_node_9 (SEQ ID NO:1156) according to the present invention is supported by 114 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 216 below describes the starting and ending position of this segment on each transcript.

TABLE 216

Segment location on transcripts

| Transcript name | Segment starting position | Segment ending position |
|---|---|---|
| F05068_PEA_1_T3 (SEQ ID NO: 25) | 665 | 748 |
| F05068_PEA_1_T4 (SEQ ID NO: 26) | 748 | 831 |
| F05068_PEA_1_T6 (SEQ ID NO: 27) | 898 | 981 |

Variant Protein Alignment to the Previously Known Protein:
Sequence name: /tmp/kEsi3RWsCN/lsvdhjfiNV:ADML_HUMAN (SEQ ID NO:1423)
Sequence documentation:
Alignment of: F05068_PEA_1_P7 (SEQ ID NO:1304) x ADML_HUMAN (SEQ ID NO:1423) ..
Alignment segment 1/1:

| Quality: | 304.00 | Escore: | 0 |
|---|---|---|---|
| Matching length: | 33 | Total length: | 33 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1   MKLVSVALMYLGSLAFLGADTARLDVASEFRKK                33
        |||||||||||||||||||||||||||||||||
  1   MKLVSVALMYLGSLAFLGADTARLDVASEFRKK                33
```

Sequence name: /tmp/tcrlWIx4 kg/aghbr8Eh8n:ADML_HUMAN (SEQ ID NO:1423)
Sequence documentation:
Alignment of: F05068_PEA_1_P8 (SEQ ID NO:1305) x ADML_HUMAN (SEQ ID NO:1423) ..
Alignment segment 1/1:

| Quality: | 791.00 | Escore: | 0 |
|---|---|---|---|
| Matching length: | 82 | Total length: | 82 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1   MKLVSVALMYLGSLAFLGADTARLDVASEFRKKWNKWALSRGKRELRMSS    50
        ||||||||||||||||||||||||||||||||||||||||||||||||||
  1   MKLVSVALMYLGSLAFLGADTARLDVASEFRKKWNKWALSRGKRELRMSS    50

51   SYPTGLADVKAGPAQTLIRPQDMKGASRSPED                      82
        |||||||||||||||||||||||||||||||
 51   SYPTGLADVKAGPAQTLIRPQDMKGASRSPED                      82
```

Description for Cluster H14624

Cluster H14624 features 1 transcript(s) and 15 segment(s) of interest, the names for which are given in Tables 217 and 218, respectively, the sequences themselves are given at the end of the application. The selected protein variants are given in table 219.

TABLE 245

Amino acid mutations

| SNP position(s) on amino acid sequence | Alternative amino acid(s) | Previously known SNP? |
|---|---|---|
| 126 | H -> Y | No |
| 129 | S -> R | Yes |
| 256 | I -> | No |
| 256 | I -> N | No |
| 258 | G -> | No |
| 266 | D -> | No |
| 266 | D -> E | No |
| 266 | D -> N | Yes |
| 296 | A -> G | No |
| 296 | A -> V | No |
| 306 | F -> C | No |
| 314 | F -> | No |
| 215 | R -> K | No |
| 361 | T -> A | No |
| 381 | K -> | No |
| 217 | L -> | No |
| 220 | D -> | No |
| 220 | D -> E | No |
| 245 | F -> | No |

TABLE 245-continued

Amino acid mutations

| SNP position(s) on amino acid sequence | Alternative amino acid(s) | Previously known SNP? |
|---|---|---|
| 245 | F -> V | No |
| 248 | K -> | No |
| 248 | K -> Q | No |

TABLE 218

Segments of interest

| Segment Name | Sequence ID No. |
|---|---|
| H14624_node_0 | 362 |
| H14624_node_16 | 363 |
| H14624_node_3 | 364 |
| H14624_node_10 | 365 |
| H14624_node_11 | 366 |
| H14624_node_12 | 367 |
| H14624_node_13 | 368 |
| H14624_node_14 | 370 |
| H14624_node_15 | 371 |
| H14624_node_4 | 372 |
| H14624_node_5 | 373 |
| H14624_node_6 | 374 |
| H14624_node_7 | 375 |
| H14624_node_8 | 376 |
| H14624_node_9 | 377 |

TABLE 219

Proteins of interest

| Protein Name | Sequence ID No. |
|---|---|
| H14624_P15 | 1306 |

Cluster H14624 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 22 refer to weighted expression of ESTs in each category, as "parts per million" (ratio of the expression of ESTs for a particular cluster to the expression of all ESTs in that category, according to parts per million).

Figure 22:
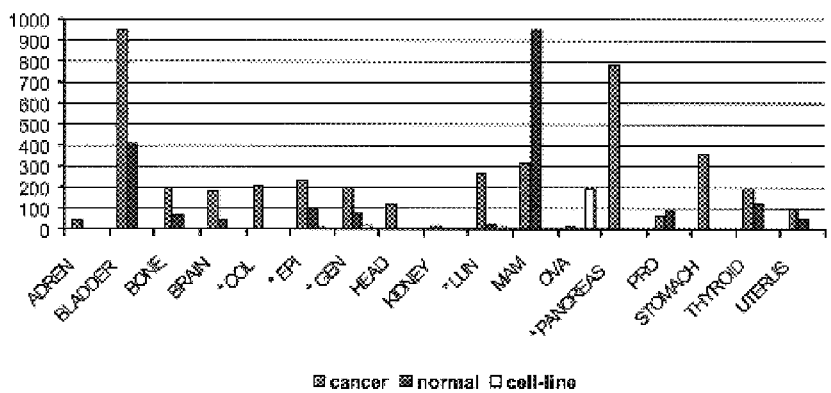
FIG. 22 is a histogram showing Cancer and cell-line vs. normal tissue expression for Cluster H14624, demonstrating overexpression in colorectal cancer, epithelial malignant tumors, a mixture of malignant tumors from different tissues, lung malignant tumors and pancreas carcinoma.

Overall, the following results were obtained as shown with regard to the histograms in FIG. 22 and Table 220. This cluster is overexpressed (at least at a minimum level) in the following pathological conditions: colorectal cancer, epithelial malignant tumors, a mixture of malignant tumors from different tissues, lung malignant tumors and pancreas carcinoma.

TABLE 220

Normal tissue distribution

| Name of Tissue | Number |
|---|---|
| adrenal | 0 |
| bladder | 410 |
| bone | 71 |
| brain | 42 |
| colon | 6 |
| epithelial | 91 |
| general | 74 |
| head and neck | 0 |
| kidney | 0 |
| lung | 30 |
| breast | 949 |
| ovary | 7 |
| pancreas | 2 |
| prostate | 94 |
| stomach | 3 |
| Thyroid | 128 |
| uterus | 54 |

TABLE 221

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 4.6e−01 | 2.2 | 5.3e−01 | 1.9 |
| bladder | 5.4e−01 | 6.0e−01 | 1.2e−02 | 1.6 | 2.2e−01 | 1.0 |
| bone | 4.9e−01 | 8.5e−01 | 1.8e−01 | 1.3 | 7.5e−01 | 0.6 |
| brain | 4.7e−01 | 7.0e−01 | 6.3e−05 | 2.3 | 9.4e−03 | 1.4 |
| colon | 4.4e−02 | 9.9e−02 | 4.5e−03 | 5.4 | 2.0e−02 | 3.9 |
| epithelial | 7.7e−03 | 3.6e−01 | 1.5e−11 | 2.0 | 2.9e−02 | 1.1 |
| general | 5.1e−03 | 5.9e−01 | 8.3e−21 | 2.2 | 1.5e−04 | 1.2 |
| head and neck | 1.4e−01 | 2.8e−01 | 4.6e−01 | 2.2 | 7.5e−01 | 1.3 |
| kidney | 6.5e−01 | 7.2e−01 | 5.8e−01 | 1.7 | 7.0e−01 | 1.4 |
| lung | 6.1e−02 | 1.4e−01 | 3.3e−05 | 5.8 | 8.1e−03 | 2.9 |
| breast | 2.4e−01 | 4.1e−01 | 1 | 0.3 | 1 | 0.2 |
| ovary | 8.5e−01 | 7.3e−01 | 6.8e−01 | 1.2 | 1.6e−01 | 1.6 |
| pancreas | 7.5e−03 | 4.9e−02 | 1.2e−21 | 22.4 | 2.4e−16 | 15.1 |
| prostate | 8.3e−01 | 8.9e−01 | 7.2e−01 | 0.8 | 8.8e−01 | 0.6 |
| stomach | 4.6e−01 | 8.5e−01 | 1.0e−03 | 2.7 | 1.1e−01 | 1.4 |
| Thyroid | 7.0e−01 | 7.0e−01 | 5.9e−01 | 1.0 | 5.9e−01 | 1.0 |
| uterus | 4.1e−01 | 7.3e−01 | 2.3e−01 | 1.2 | 6.2e−01 | 0.7 |

As noted above, contig H14624 features 1 transcript(s), which were listed in Table 217 above. A description of each variant protein according to the present invention is now provided.

Variant protein H14624_P15 (SEQ ID NO:1306) according to the present invention has an amino acid sequence as given at the end of the application; it is encoded by transcript(s) H14624_T20 (SEQ ID NO:28). One or more alignments to one or more previously published protein sequences are given at the end of the application. A brief description of the relationship of the variant protein according to the present invention to each such aligned protein is as follows:

Comparison Report Between H14624_P15 (SEQ ID NO:1306) and Q9HAP5 (SEQ ID NO:1701):

1. An isolated chimeric polypeptide encoding for H14624_P15 (SEQ ID NO:1306), comprising a first amino acid sequence being at least 90% homologous to MLQG-PGSLLLLFLASHCCLGSARGLFLFGQP-DFSYKRSNCKPIPANLQLCHGIEYQNMR LPN-LLGHETMKEVLEQAGAWIPLVMKQCHPDTKKFLCS LFAPVCLDDLDETIQPCHSLC VQVKDRCAPVMSAF-GFPWPDMLECDRFPQDNDLCIPLASSDHLLPATEE corresponding to amino acids 1-167 of Q9HAP5 (SEQ ID NO:1701), which also corresponds to amino acids 1-167 of H14624_P15 (SEQ ID NO:1306), and a second amino acid sequence being at least 70%, optionally at least 80%, preferably at least 85%, more preferably at least 90% and most preferably at least 95% homologous to a polypeptide having the sequence GKPSLLLPHSLLG (SEQ ID NO:1765) corresponding to amino acids 168-180 of H14624_P15 (SEQ ID NO:1306), wherein said first and second amino acid sequences are contiguous and in a sequential order.

2. An isolated polypeptide encoding for a tail of H14624_P15 (SEQ ID NO:1306), comprising a polypeptide being at least 70%, optionally at least about 80%, preferably at least about 85%, more preferably at least about 90% and most preferably at least about 95% homologous to the sequence GKPSLLLPHSLLG (SEQ ID NO:1765) in H14624_P15 (SEQ ID NO:1306).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H14624_P15 (SEQ ID NO:1306) also has the following non-silent SNPs (Single Nucleotide Polymorphisms) as listed in Table 222, (given according to their position(s) on the amino acid sequence, with the alternative amino acid(s) listed; the last column indicates whether the SNP is known or not; the presence of known SNPs in variant protein H14624_P15 (SEQ ID NO:1306) sequence provides support for the deduced sequence of this variant protein according to the present invention).

TABLE 222

Amino acid mutations

| SNP position(s) on amino acid sequence | Alternative amino acid(s) | Previously known SNP? |
|---|---|---|
| 11 | L -> | No |
| 170 | P -> S | Yes |
| 28 | F -> | No |
| 29 | G -> | No |
| 38 | S -> | No |
| 45 | A -> V | Yes |
| 60 | L -> | No |

Variant protein H14624_P15 (SEQ ID NO:1306) is encoded by the following transcript(s): H14624_T20 (SEQ ID NO:28), for which the sequence(s) is/are given at the end of the application. The coding portion of transcript H14624_T20 (SEQ ID NO:28) is shown in bold; this coding portion starts at position 857 and ends at position 1396. The transcript also has the following SNPs as listed in Table 223 (given according to their position on the nucleotide sequence, with the alternative nucleic acid listed; the last column indicates whether the SNP is known or not; the presence of known SNPs in variant protein H14624_P15 (SEQ ID NO:1306) sequence provides support for the deduced sequence of this variant protein according to the present invention).

TABLE 223

Nucleic acid SNPs

| SNP position on nucleotide sequence | Alternative nucleic acid | Previously known SNP? |
|---|---|---|
| 389 | A -> G | No |
| 476 | C -> T | No |
| 969 | G -> | No |
| 988 | G -> T | Yes |
| 990 | C -> T | Yes |
| 1034 | C -> | No |
| 1168 | C -> T | Yes |
| 1364 | C -> T | Yes |
| 488 | T -> C | No |
| 819 | C -> G | Yes |
| 851 | C -> | No |
| 887 | C -> | No |
| 922 | G -> A | Yes |
| 934 | C -> T | Yes |
| 938 | T -> | No |
| 943 | C -> | No |

As noted above, cluster H14624 features 15 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H14624_node_0 (SEQ ID NO:1157) according to the present invention is supported by 3 libraries. The number of libraries was determined as previously described. This segment can be found in the following transcript(s): H14624_T20 (SEQ ID NO:28). Table 224 below describes the starting and ending position of this segment on each transcript.

TABLE 224

Segment location on transcripts

| Transcript name | Segment starting position | Segment ending position |
|---|---|---|
| H14624_T20 (SEQ ID NO: 28) | 1 | 573 |

Segment cluster H14624_node_16 (SEQ ID NO:1158) according to the present invention is supported by 3 libraries. The number of libraries was determined as previously described. This segment can be found in the following transcript(s): H14624_T20 (SEQ ID NO:28). Table 225 below describes the starting and ending position of this segment on each transcript.

TABLE 225

Segment location on transcripts

| Transcript name | Segment starting position | Segment ending position |
|---|---|---|
| H14624_T20 (SEQ ID NO: 28) | 1359 | 1745 |

Segment cluster H14624_node_3 (SEQ ID NO:1159) according to the present invention is supported by 67 libraries. The number of libraries was determined as previously described. This segment can be found in the following transcript(s): H14624_T20 (SEQ ID NO:28). Table 226 below describes the starting and ending position of this segment on each transcript.

TABLE 226

Segment location on transcripts

| Transcript name | Segment starting position | Segment ending position |
|---|---|---|
| H14624_T20 (SEQ ID NO: 28) | 574 | 822 |

According to an optional embodiment of the present invention, short segments related to the above cluster are also provided. These segments are up to about 120 bp in length, and so are included in a separate description.

Segment cluster H114624_node_10 (SEQ ID NO:1160) according to the present invention can be found in the following transcript(s): H14624_T20 (SEQ ID NO:28). Table 227 below describes the starting and ending position of this segment on each transcript.

TABLE 227

Segment location on transcripts

| Transcript name | Segment starting position | Segment ending position |
|---|---|---|
| H14624_T20 (SEQ ID NO: 28) | 1070 | 1079 |

Segment cluster H14624_node_11 (SEQ ID NO:1161) according to the present invention is supported by 99 libraries. The number of libraries was determined as previously described. This segment can be found in the following transcript(s): H14624_T20 (SEQ ID NO:28). Table 228 below describes the starting and ending position of this segment on each transcript.

TABLE 228

Segment location on transcripts

| Transcript name | Segment starting position | Segment ending position |
|---|---|---|
| H14624_T20 (SEQ ID NO: 28) | 1080 | 1114 |

Segment cluster H14624_node_12 (SEQ ID NO:1162) according to the present invention can be found in the following transcript(s): H14624_T20 (SEQ ID NO:28). Table 229 below describes the starting and ending position of this segment on each transcript.

TABLE 229

Segment location on transcripts

| Transcript name | Segment starting position | Segment ending position |
|---|---|---|
| H14624_T20 (SEQ ID NO: 28) | 1115 | 1135 |

Segment cluster H14624_node_13 (SEQ ID NO:1163) according to the present invention is supported by 124 libraries. The number of libraries was determined as previously described. This segment can be found in the following transcript(s): H14624_T20 (SEQ ID NO:28). Table 230 below describes the starting and ending position of this segment on each transcript.

TABLE 230

3Segment location on transcripts

| Transcript name | Segment starting position | Segment ending position |
|---|---|---|
| H14624_T20 (SEQ ID NO: 28) | 1136 | 1227 |

Segment cluster H14624_node_14 (SEQ ID NO:1164) according to the present invention is supported by 114 libraries. The number of libraries was determined as previously described. This segment can be found in the following transcript(s): H14624_T20 (SEQ ID NO:28). Table 231 below describes the starting and ending position of this segment on each transcript.

TABLE 231

Segment location on transcripts

| Transcript name | Segment starting position | Segment ending position |
|---|---|---|
| H14624_T20 (SEQ ID NO: 28) | 1228 | 1287 |

Segment cluster H14624_node_15 (SEQ ID NO:1165) according to the present invention is supported by 124 libraries. The number of libraries was determined as previously described. This segment can be found in the following transcript(s): H14624_T20 (SEQ ID NO:28). Table 232 below describes the starting and ending position of this segment on each transcript.

TABLE 232

Segment location on transcripts

| Transcript name | Segment starting position | Segment ending position |
|---|---|---|
| H14624_T20 (SEQ ID NO: 28) | 1288 | 1358 |

Segment cluster H14624_node_4 (SEQ ID NO:1166) according to the present invention is supported by 65 libraries. The number of libraries was determined as previously described. This segment can be found in the following transcript(s): H14624_T20 (SEQ ID NO:28). Table 233 below describes the starting and ending position of this segment on each transcript.

TABLE 233

Segment location on transcripts

| Transcript name | Segment starting position | Segment ending position |
|---|---|---|
| H14624_T20 (SEQ ID NO: 28) | 823 | 892 |

Segment cluster H14624_node_5 (SEQ ID NO:1167) according to the present invention can be found in the following transcript(s): H14624_T20 (SEQ ID NO:28). Table 234 below describes the starting and ending position of this segment on each transcript.

TABLE 234

Segment location on transcripts

| Transcript name | Segment starting position | Segment ending position |
|---|---|---|
| H14624_T20 (SEQ ID NO: 28) | 893 | 903 |

Segment cluster H14624_node_6 (SEQ ID NO:1168) according to the present invention can be found in the following transcript(s): H14624_T20 (SEQ ID NO:28). Table 235 below describes the starting and ending position of this segment on each transcript.

TABLE 235

| | Segment location on transcripts | |
|---|---|---|
| Transcript name | Segment starting position | Segment ending position |
| H14624_T20 (SEQ ID NO: 28) | 904 | 927 |

Segment cluster H14624_node_7 (SEQ ID NO:1169) according to the present invention can be found in the following transcript(s): H14624_T20 (SEQ ID NO:28). Table 236 below describes the starting and ending position of this segment on each transcript.

TABLE 236

| | Segment location on transcripts | |
|---|---|---|
| Transcript name | Segment starting position | Segment ending position |
| H14624_T20 (SEQ ID NO: 28) | 928 | 934 |

Segment cluster H14624_node_8 (SEQ ID NO:1170) according to the present invention is supported by 85 libraries. The number of libraries was determined as previously described. This segment can be found in the following transcript(s): H14624_T20 (SEQ ID NO:28). Table 237 below describes the starting and ending position of this segment on each transcript.

TABLE 237

| | Segment location on transcripts | |
|---|---|---|
| Transcript name | Segment starting position | Segment ending position |
| H14624_T20 (SEQ ID NO: 28) | 935 | 1014 |

Segment cluster H14624_node_9 (SEQ ID NO:1171) according to the present invention is supported by 87 libraries. The number of libraries was determined as previously described. This segment can be found in the following transcript(s): H14624_T20 (SEQ ID NO:28). Table 238 below describes the starting and ending position of this segment on each transcript.

TABLE 238

| | Segment location on transcripts | |
|---|---|---|
| Transcript name | Segment starting position | Segment ending position |
| H14624_T20 (SEQ ID NO: 28) | 1015 | 1069 |

Variant Protein Alignment to the Previously Known Protein:

Sequence name: /tmp/Upb1SbFkrj/N4PrGQAB2V:Q9HAP5 (SEQ ID NO:1701)

Sequence documentation:

Alignment of: H14624_P15 (SEQ ID NO:1306) x Q9HAP5 (SEQ ID NO:1701) ..

Alignment segment 1/1:

| Quality: | 1702.00 | Escore: | 0 |
|---|---|---|---|
| Matching length: | 167 | Total length: | 167 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MLQGPGSLLLLFLASHCCLGSARGLFLFGQPDFSYKRSNCKPIPANLQLC   50
     ||||||||||||||||||||||||||||||||||||||||||||||||||
  1  MLQGPGSLLLLFLASHCCLGSARGLFLFGQPDFSYKRSNCKPIPANLQLC   50

51  HGIEYQNMRLPNLLGHETMKEVLEQAGAWIPLVMKQCHPDTKKFLCSLFA  100
     ||||||||||||||||||||||||||||||||||||||||||||||||||
 51  HGIEYQNMRLPNLLGHETMKEVLEQAGAWIPLVMKQCHPDTKKFLCSLFA  100

101  PVCLDDLDETIQPCHSLCVQVKDRCAPVMSAFGFPWPDMLECDRFPQDND  150
     ||||||||||||||||||||||||||||||||||||||||||||||||||
101  PVCLDDLDETIQPCHSLCVQVKDRCAPVMSAFGFPWPDMLECDRFPQDND  150

151  LCIPLASSDHLLPATEE                                  167
     |||||||||||||||||
151  LCIPLASSDHLLPATEE                                  167
```

Description for Cluster H38804

Cluster H38804 features 2 transcript(s) and 20 segment(s) of interest, the names for which are given in Tables 239 and 240, respectively, the sequences themselves are given at the end of the application. The selected protein variants are given in table 241.

TABLE 239

Transcripts of interest

| Transcript Name | Sequence ID No. |
|---|---|
| H38804_PEA_1_T24 | 29 |
| H38804_PEA_1_T8 | 30 |

TABLE 240

Segments of interest

| Segment Name | Sequence ID No. |
|---|---|
| H38804_PEA_1_node_0 | 378 |
| H38804_PEA_1_node_1 | 379 |
| H38804_PEA_1_node_16 | 380 |
| H38804_PEA_1_node_19 | 381 |
| H38804_PEA_1_node_24 | 382 |
| H38804_PEA_1_node_25 | 383 |
| H38804_PEA_1_node_28 | 384 |
| H38804_PEA_1_node_29 | 385 |
| H38804_PEA_1_node_30 | 386 |
| H38804_PEA_1_node_10 | 387 |
| H38804_PEA_1_node_12 | 388 |
| H38804_PEA_1_node_13 | 389 |
| H38804_PEA_1_node_14 | 390 |
| H38804_PEA_1_node_2 | 391 |
| H38804_PEA_1_node_20 | 392 |
| H38804_PEA_1_node_23 | 393 |
| H38804_PEA_1_node_26 | 394 |
| H38804_PEA_1_node_3 | 395 |
| H38804_PEA_1_node_4 | 396 |
| H38804_PEA_1_node_5 | 397 |

TABLE 241

Proteins of interest

| Protein Name | Sequence ID No. |
|---|---|
| H38804_PEA_1_P5 | 1307 |
| H38804_PEA_1_P17 | 1308 |

These sequences are variants of the known protein Mitotic checkpoint protein BUB3 (SwissProt accession identifier BUB3_HUMAN), SEQ ID NO:1424, referred to herein as the previously known protein.

Protein Mitotic checkpoint protein BUB3 (SEQ ID NO:1424) is known or believed to have the following function(s): Required for kinetochore localization of BUB1. The sequence for protein Mitotic checkpoint protein BUB3 is given at the end of the application, as "Mitotic checkpoint protein BUB3 amino acid sequence". Known polymorphisms for this sequence are as shown in Table 242

TABLE 242

Amino acid mutations for Known Protein

| SNP position(s) on amino acid sequence | Comment |
|---|---|
| 326-327 | Missing |

Protein Mitotic checkpoint protein BUB3 (SEQ ID NO:1424) localization is believed to be Nuclear.

The following GO Annotation(s) apply to the previously known protein. The following annotation(s) were found: mitosis; mitotic checkpoint; mitotic spindle checkpoint; cell proliferation, which are annotation(s) related to Biological Process; and nucleus, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster H38804 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 23 refer to weighted expression of ESTs in each category, as "parts per million" (ratio of the expression of ESTs for a particular cluster to the expression of all ESTs in that category, according to parts per million).

Figure 23:
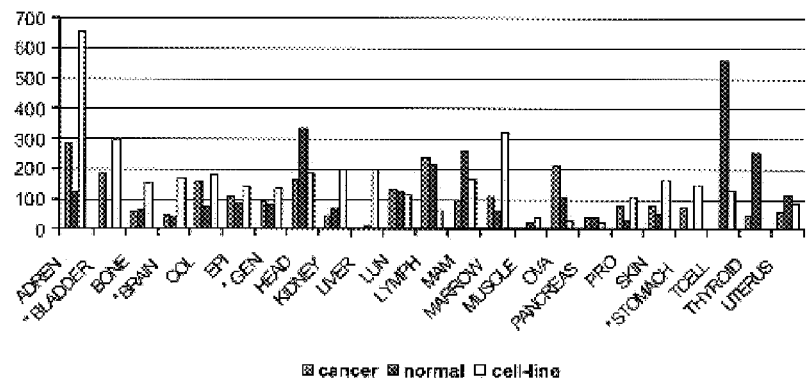
FIG. 23 is a histogram showing Cancer and cell-line vs. normal tissue expression for Cluster H38804, demonstrating overexpression in transitional cell carcinoma, brain malignant tumors, a mixture of malignant tumors from different tissues and gastric carcinoma.

Overall, the following results were obtained as shown with regard to the histograms in FIG. 23 and Table 243. This cluster is overexpressed (at least at a minimum level) in the following pathological conditions: transitional cell carcinoma, brain malignant tumors, a mixture of malignant tumors from different tissues and gastric carcinoma.

TABLE 243

Normal tissue distribution

| Name of Tissue | Number |
|---|---|
| adrenal | 124 |
| bladder | 0 |
| bone | 64 |
| brain | 40 |
| colon | 75 |
| epithelial | 86 |
| general | 79 |
| head and neck | 334 |
| kidney | 69 |
| liver | 14 |
| lung | 125 |
| lymph nodes | 218 |
| breast | 263 |
| bone marrow | 62 |
| muscle | 27 |
| ovary | 109 |
| pancreas | 43 |
| prostate | 32 |
| skin | 53 |
| stomach | 0 |
| T cells | 557 |
| Thyroid | 257 |
| uterus | 113 |

TABLE 244

P values and ratios for expression in cancerous tissue

| Name of Tissue | P1 | P2 | SP1 | R3 | SP2 | R4 |
|---|---|---|---|---|---|---|
| adrenal | 6.3e-01 | 5.4e-01 | 1.8e-01 | 1.4 | 5.0e-02 | 1.9 |
| bladder | 7.0e-02 | 2.6e-02 | 3.2e-02 | 4.9 | 9.9e-03 | 6.2 |
| bone | 3.7e-01 | 2.3e-01 | 7.9e-01 | 0.9 | 3.2e-01 | 1.6 |
| brain | 3.1e-02 | 4.2e-03 | 5.3e-01 | 1.2 | 1.1e-02 | 2.1 |
| colon | 2.4e-01 | 1.1e-01 | 2.0e-01 | 1.7 | 1.6e-01 | 1.8 |
| epithelial | 1.1e-01 | 2.2e-02 | 1.5e-01 | 1.2 | 8.6e-03 | 1.3 |
| general | 2.3e-02 | 2.3e-04 | 9.0e-02 | 1.2 | 4.7e-05 | 1.4 |
| head and neck | 4.4e-01 | 4.7e-01 | 9.2e-01 | 0.6 | 8.9e-01 | 0.5 |
| kidney | 8.2e-01 | 8.4e-01 | 9.0e-01 | 0.8 | 3.5e-01 | 1.0 |
| liver | 8.3e-01 | 1.5e-01 | 1 | 0.8 | 5.3e-02 | 2.8 |
| lung | 6.9e-01 | 8.1e-01 | 5.1e-01 | 1.1 | 6.0e-01 | 0.8 |
| lymph nodes | 5.1e-01 | 6.9e-01 | 5.0e-01 | 0.9 | 9.5e-01 | 0.5 |
| breast | 4.9e-01 | 4.2e-01 | 9.7e-01 | 0.5 | 9.5e-01 | 0.5 |
| bone marrow | 6.7e-01 | 5.4e-01 | 1 | 1.5 | 3.3e-02 | 2.6 |
| muscle | 8.5e-01 | 6.1e-01 | 1 | 0.4 | 6.3e-01 | 1.0 |
| ovary | 3.4e-01 | 3.3e-01 | 2.5e-01 | 1.5 | 4.7e-01 | 1.1 |
| pancreas | 4.3e-01 | 4.9e-01 | 6.3e-01 | 1.0 | 6.9e-01 | 0.9 |
| prostate | 7.4e-01 | 6.5e-01 | 1.5e-01 | 1.9 | 1.0e-01 | 2.0 |
| skin | 6.0e-01 | 1.7e-01 | 5.4e-01 | 1.4 | 2.7e-02 | 1.2 |
| stomach | 4.5e-02 | 9.9e-03 | 2.5e-01 | 3.1 | 4.3e-02 | 4.3 |
| T cells | 5.0e-01 | 6.7e-01 | 1 | 0.3 | 9.8e-01 | 0.5 |
| Thyroid | 5.7e-01 | 5.7e-01 | 1 | 0.4 | 1 | 0.4 |
| uterus | 5.7e-01 | 6.7e-01 | 9.2e-01 | 0.6 | 8.7e-01 | 0.5 |

As noted above, cluster H38804 features 2 transcript(s), which were listed in Table 239 above. These transcript(s) encode for protein(s) which are variant(s) of protein Mitotic checkpoint protein BUB3 (SEQ ID NO:1424). A description of each variant protein according to the present invention is now provided.

Variant protein H38804_PEA_1_P5 (SEQ ID NO:1307) according to the present invention has an amino acid sequence as given at the end of the application; it is encoded by transcript(s) H38804_PEA_1_T8 (SEQ ID NO:30). An alignment is given to the known protein (Mitotic checkpoint protein BUB3 (SEQ ID NO:1424)) at the end of the application. One or more alignments to one or more previously published protein sequences are given at the end of the application. A brief description of the relationship of the variant protein according to the present invention to each such aligned protein is as follows:

Comparison Report Between H38804_PEA_1_P5 (SEQ ID NO:1307) and BUB3_HUMAN (SEQ ID NO:1424):

1. An isolated chimeric polypeptide encoding for H38804_PEA_1_P5 (SEQ ID NO:1307) comprising a first amino acid sequence being at least 70%, optionally at least 80%, preferably at least 85%, more preferably at least 90% and most preferably at least 95% homologous to a polypeptide having the sequence MGRVRTLAGECSAQAQAQS-LLAVVLSAPPSGGTPSARLSVRSPSPRD-PWGLWAPVLQ (SEQ ID NO:1766) corresponding to amino acids 1-57 of H38804_PEA_1_P5 (SEQ ID NO:1307), and a second amino acid sequence being at least 90% homologous to MTGSNEFKLNQPPEDGISSVKFSP-NTSQFLLVSSWDTSVRLYDVPANSMRLKYQHTGA VLDCAFYDPTHAWSGGLDHQLKMHDLNT-DQENLVGTHDAPIRCVEYCPEVNVMVTG SWDQTVKLWDPRTPCNAGTFSQPE-KVYTLSVSGDRLIVGTAGRRVLVWDLRNMGYVQ QRRESSLKYQTRCIRAFPNKQGYVLSS-IEGRVAVEYLDPSPEVQKKKYAFKCHRLKENN IEQIYPVNAISFHNIHNTFATGGSDG-FVNIWDPFNKKRLCQFHRYPTSIASLAFSNDGTTL AIASSYMYEMDDTEHPEDGIFIRQVTDAETKPK corresponding to amino acids 1-324 of BUB3_HUMAN (SEQ ID NO:1424), which also corresponds to amino acids 58-381 of H38804_PEA_1_P5 (SEQ ID NO:1307), wherein said first and second amino acid sequences are contiguous and in a sequential order.

2. An isolated polypeptide encoding for a head of H38804_PEA_1_P5 (SEQ ID NO:1307), comprising a polypeptide being at least 70%, optionally at least about 80%, preferably at least about 85%, more preferably at least about 90% and most preferably at least about 95% homologous to the sequence MGRVRTLAGECSAQAQAQSLLAVVL-SAPPSGGTPSARLSVRSPSPRDPWGLWAPVLQ (SEQ ID NO:1766) of H38804_PEA_1_P5 (SEQ ID NO:1307).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-de peptide prediction programs (HMM:Signal peptide,NN:NO) predicts that this protein has a signal peptide.

Variant protein H38804_PEA_1_P5 (SEQ ID NO:1307) also has the following non-silent SNPs (Single Nucleotide Polymorphisms) as listed in Table 245, (given according to their position(s) on the amino acid sequence, with the alternative amino acid(s) listed; the last column indicates whether the SNP is known or not; the presence of known SNPs in variant protein H38804_PEA_1_P5 (SEQ ID NO:1307) sequence provides support for the deduced sequence of this variant protein according to the present invention).

TABLE 245

Amino acid mutations

| SNP position(s) on amino acid sequence | Alternative amino acid(s) | Previously known SNP? |
|---|---|---|
| 126 | H -> Y | No |
| 129 | S -> R | Yes |
| 256 | I -> | No |
| 256 | I -> N | No |
| 258 | G -> | No |
| 266 | D -> | No |
| 266 | D -> E | No |
| 266 | D -> N | Yes |
| 296 | A -> G | No |
| 296 | A -> V | No |
| 306 | F -> C | No |
| 314 | F -> | No |
| 215 | R -> K | No |
| 361 | T -> A | No |
| 381 | K -> | No |
| 217 | L -> | No |
| 220 | D -> | No |
| 220 | D -> E | No |
| 245 | F -> | No |
| 245 | F -> V | No |
| 248 | K -> | No |
| 248 | K -> Q | No |

Variant protein H38804_PEA_1_P5 (SEQ ID NO:1307) is encoded by the following transcript(s): H38804_PEA_1_T8 (SEQ ID NO:30), for which the sequence(s) is/are given at the end of the application. The coding portion of transcript H38804_PEA_1_T8 (SEQ ID NO:30) is shown in bold; this coding portion starts at position 475 and ends at position 1617. The transcript also has the following SNPs as listed in Table 246 (given according to their position on the nucleotide sequence, with the alternative nucleic acid listed; the last column indicates whether the SNP is known or not; the presence of known SNPs in variant protein H38804_PEA_1_P5 (SEQ ID NO:1307) sequence provides support for the deduced sequence of this variant protein according to the present invention).

TABLE 246

Nucleic acid SNPs

| SNP position on nucleotide sequence | Alternative nucleic acid | Previously known SNP? |
|---|---|---|
| 161 | C -> | No |
| 167 | C -> | No |
| 1118 | G -> A | No |
| 1123 | T -> | No |
| 1134 | C -> | No |
| 1134 | C -> A | No |
| 1207 | T -> | No |
| 1207 | T -> G | No |
| 1216 | A -> | No |
| 1216 | A -> C | No |
| 1241 | T -> | No |
| 1241 | T -> A | No |
| 167 | C -> A | No |
| 1248 | C -> | No |
| 1248 | C -> G | No |
| 1270 | G -> A | Yes |
| 1272 | C -> | No |
| 1272 | C -> A | No |
| 1361 | C -> G | No |
| 1361 | C -> T | No |
| 1391 | T -> G | No |
| 1414 | T -> | No |
| 1419 | A -> G | No |
| 192 | T -> | No |
| 1555 | A -> G | No |
| 1615 | A -> | No |
| 1642 | G -> A | Yes |
| 1846 | T -> C | Yes |
| 2090 | A -> G | No |
| 2356 | C -> G | No |
| 2712 | G -> | No |
| 2909 | T -> C | No |
| 2909 | T -> G | No |
| 3020 | T -> G | No |
| 208 | C -> T | Yes |
| 3251 | T -> | No |
| 3306 | T -> | No |
| 3307 | T -> G | No |
| 3354 | T -> | No |
| 3521 | -> G | No |
| 3601 | C -> | No |
| 3601 | C -> G | No |
| 3633 | T -> | No |
| 3633 | T -> G | No |
| 3638 | A -> | No |
| 849 | G -> T | No |
| 3638 | A -> C | No |
| 3674 | C -> T | Yes |
| 3812 | T -> G | No |
| 3862 | G -> A | Yes |
| 3864 | T -> A | No |
| 3865 | T -> A | No |
| 3990 | T -> G | No |
| 4096 | T -> G | No |
| 4152 | G -> A | Yes |
| 850 | C -> T | No |
| 855 | C -> T | Yes |
| 861 | T -> G | Yes |
| 1098 | T -> C | No |

Variant protein H38804_PEA_1_P17 (SEQ ID NO:1308) according to the present invention has an amino acid sequence as given at the end of the application; it is encoded by transcript(s) H38804_PEA_1_T24 (SEQ ID NO:29). An alignment is given to the known protein (Mitotic checkpoint protein BUB3 (SEQ ID NO:1424)) at the end of the application. One or more alignments to one or more previously published protein sequences are given at the end of the application. A brief description of the relationship of the variant protein according to the present invention to each such aligned protein is as follows:

Comparison Report Between H38804_PEA_1_P17 (SEQ ID NO:1308) and BUB3_HUMAN (SEQ ID NO:1424):

1. An isolated chimeric polypeptide encoding for H38804_PEA_1_P17 (SEQ ID NO:1308), comprising a first amino acid sequence being at least 70%, optionally at least 80%, preferably at least 85%, more preferably at least 90% and most preferably at least 95% homologous to a polypeptide having the sequence MGRVRTLAGECSAQAQAQSLLAVVLSAPPSGGTPSARLSVRSPSPRDPWGLWAPVLQ (SEQ ID NO:1766) corresponding to amino acids 1-57 of H38804_PEA_1_P17 (SEQ ID NO:1308), and a second amino acid sequence being at least 90% homologous to MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT corresponding to amino acids 1-328 of BUB3_HUMAN (SEQ ID NO:1424), which also corresponds to amino acids 58-385 of H38804_PEA_1_P17 (SEQ ID NO:1308), wherein said first and second amino acid sequences are contiguous and in a sequential order.

2. An isolated polypeptide encoding for a head of H38804_PEA_1_P17 (SEQ ID NO:1308), comprising a polypeptide being at least 70%, optionally at least about 80%, preferably at least about 85%, more preferably at least about 90% and most preferably at least about 95% homologous to the sequence MGRVRTLAGECSAQAQAQSLLAVVLSAPPSGGTPSARLSVRSPSPRDPWGLWAPVLQ (SEQ ID NO:1766) of H38804_PEA_1_P17 (SEQ ID NO:1308).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide,NN:NO) predicts that this protein has a signal peptide.

Variant protein H38804_PEA_1_P17 (SEQ ID NO:1308) also has the following non-silent SNPs (Single Nucleotide Polymorphisms) as listed in Table 247, (given according to their position(s) on the amino acid sequence, with the alternative amino acid(s) listed; the last column indicates whether the SNP is known or not; the presence of known SNPs in variant protein H38804_PEA_1_P17 (SEQ ID NO:1308) sequence provides support for the deduced sequence of this variant protein according to the present invention).

TABLE 247

Amino acid mutations

| SNP position(s) on amino acid sequence | Alternative amino acid(s) | Previously known SNP? |
|---|---|---|
| 126 | H -> Y | No |
| 129 | S -> R | Yes |

TABLE 247-continued

Amino acid mutations

| SNP position(s) on amino acid sequence | Alternative amino acid(s) | Previously known SNP? |
|---|---|---|
| 256 | I -> | No |
| 256 | I -> N | No |
| 258 | G -> | No |
| 266 | D -> | No |
| 266 | D -> E | No |
| 266 | D -> N | Yes |
| 296 | A -> G | No |
| 296 | A -> V | No |
| 306 | F -> C | No |
| 314 | F -> | No |
| 215 | R -> K | No |
| 361 | T -> A | No |
| 381 | K -> | No |
| 217 | L -> | No |
| 220 | D -> | No |
| 220 | D -> E | No |
| 245 | F -> | No |
| 245 | F -> V | No |
| 248 | K -> | No |
| 248 | K -> Q | No |

Variant protein H38804_PEA_1_P17 (SEQ ID NO:1308) is encoded by the following transcript(s): H38804_PEA_1_T24 (SEQ ID NO:29), for which the sequence(s) is/are given at the end of the application. The coding portion of transcript H38804_PEA_1_T24 (SEQ ID NO:29) is shown in bold; this coding portion starts at position 475 and ends at position 1629. The transcript also has the following SNPs as listed in Table 248 (given according to their position on the nucleotide sequence, with the alternative nucleic acid listed; the last column indicates whether the SNP is known or not; the presence of known SNPs in variant protein H38804_PEA_1_P17 (SEQ ID NO:1308) sequence provides support for the deduced sequence of this variant protein according to the present invention).

TABLE 248

Nucleic acid SNPs

| SNP position on nucleotide sequence | Alternative nucleic acid | Previously known SNP? |
|---|---|---|
| 161 | C -> | No |
| 167 | C -> | No |
| 1118 | G -> A | No |
| 1123 | T -> | No |
| 1134 | C -> | No |
| 1134 | C -> A | No |
| 1207 | T -> | No |
| 1207 | T -> G | No |
| 1216 | A -> | No |
| 1216 | A -> C | No |
| 1241 | T -> | No |
| 1241 | T -> A | No |
| 167 | C -> A | No |
| 1248 | C -> | No |
| 1248 | C -> G | No |
| 1270 | G -> A | Yes |
| 1272 | C -> | No |
| 1272 | C -> A | No |
| 1361 | C -> G | No |
| 1361 | C -> T | No |
| 1391 | T -> G | No |
| 1414 | T -> | No |
| 1419 | A -> G | No |
| 192 | T -> | No |
| 1555 | A -> G | No |
| 1615 | A -> | No |

TABLE 248-continued

Nucleic acid SNPs

| SNP position on nucleotide sequence | Alternative nucleic acid | Previously known SNP? |
|---|---|---|
| 1721 | G -> | No |
| 1918 | T -> C | No |
| 1918 | T -> G | No |
| 2029 | T -> G | No |
| 2260 | T -> | No |
| 2315 | T -> | No |
| 2316 | T -> G | No |
| 2363 | T -> | No |
| 208 | C -> T | Yes |
| 2530 | -> G | No |
| 2610 | C -> | No |
| 2610 | C -> G | No |
| 2642 | T -> | No |
| 2642 | T -> G | No |
| 2647 | A -> | No |
| 2647 | A -> C | No |
| 2683 | C -> T | Yes |
| 2821 | T -> G | No |
| 2871 | G -> A | Yes |
| 849 | G -> T | No |
| 2873 | T -> A | No |
| 2874 | T -> A | No |
| 2999 | T -> G | No |
| 3105 | T -> G | No |
| 3161 | G -> A | Yes |
| 850 | C -> T | No |
| 855 | C -> T | Yes |
| 861 | T -> G | Yes |
| 1098 | T -> C | No |

As noted above, cluster H38804 features 20 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H38804_PEA_1_node_0 (SEQ ID NO:1172) according to the present invention is supported by 125 libraries. The number of libraries was determined as previously described. This segment can be found in the following transcript(s): H38804_PEA_1_T24 (SEQ ID NO:29) and H38804_PEA_1_T8 (SEQ ID NO:30). Table 249 below describes the starting and ending position of this segment on each transcript.

TABLE 249

Segment location on transcripts

| Transcript name | Segment starting position | Segment ending position |
|---|---|---|
| H38804_PEA_1_T24 (SEQ ID NO: 29) | 1 | 213 |
| H38804_PEA_1_T8 (SEQ ID NO: 30) | 1 | 213 |

Segment cluster H38804_PEA_1_node_1 (SEQ ID NO:1173) according to the present invention is supported by 9 libraries. The number of libraries was determined as previously described. This segment can be found in the following transcript(s): H38804_PEA_1_T24 (SEQ ID NO:29) and H38804_PEA_1_T8 (SEQ ID NO:30). Table 250 below describes the starting and ending position of this segment on each transcript.

TABLE 250

Segment location on transcripts

| Transcript name | Segment starting position | Segment ending position |
|---|---|---|
| H38804_PEA_1_T24 (SEQ ID NO: 29) | 214 | 645 |
| H38804_PEA_1_T8 (SEQ ID NO: 30) | 214 | 645 |

Segment cluster H38804_PEA_1_node_16 (SEQ ID NO:1174) according to the present invention is supported by 214 libraries. The number of libraries was determined as previously described. This segment can be found in the following transcript(s): H38804_PEA_1_T24 (SEQ ID NO:29) and H38804_PEA_1_T8 (SEQ ID NO:30). Table 251 below describes the starting and ending position of this segment on each transcript.

TABLE 251

Segment location on transcripts

| Transcript name | Segment starting position | Segment ending position |
|---|---|---|
| H38804_PEA_1_T24 (SEQ ID NO: 29) | 1063 | 1221 |
| H38804_PEA_1_T8 (SEQ ID NO: 30) | 1063 | 1221 |

Segment cluster H38804_PEA_1_node_19 (SEQ ID NO:1175) according to the present invention is supported by 198 libraries. The number of libraries was determined as previously described. This segment can be found in the following transcript(s): H38804_PEA_1_T24 (SEQ ID NO:29) and H38804_PEA_1_T8 (SEQ ID NO:30). Table 252 below describes the starting and ending position of this segment on each transcript.

TABLE 252

Segment location on transcripts

| Transcript name | Segment starting position | Segment ending position |
|---|---|---|
| H38804_PEA_1_T24 (SEQ ID NO: 29) | 1222 | 1360 |
| H38804_PEA_1_T8 (SEQ ID NO: 30) | 1222 | 1360 |

Segment cluster H38804_PEA_1_node_24 (SEQ ID NO:1176) according to the present invention is supported by 180 libraries. The number of libraries was determined as previously described. This segment can be found in the following transcript(s): H38804_PEA_1_T24 (SEQ ID NO:29) and H38804_PEA_1_T8 (SEQ ID NO:30). Table 253 below describes the starting and ending position of this segment on each transcript.

TABLE 253

Segment location on transcripts

| Transcript name | Segment starting position | Segment ending position |
|---|---|---|
| H38804_PEA_1_T24 (SEQ ID NO: 29) | 1421 | 1616 |
| H38804_PEA_1_T8 (SEQ ID NO: 30) | 1421 | 1616 |

Segment cluster H38804_PEA_1_node_25 (SEQ ID NO:1177) according to the present invention is supported by 28 libraries. The number of libraries was determined as previously described. This segment can be found in the following transcript(s): H38804_PEA_1_T8 (SEQ ID NO:30). Table 254 below describes the starting and ending position of this segment on each transcript.

TABLE 254

Segment location on transcripts

| Transcript name | Segment starting position | Segment ending position |
|---|---|---|
| H38804_PEA_1_T8 (SEQ ID NO: 30) | 1617 | 1969 |

Segment cluster H38804_PEA_1_node_28 (SEQ ID NO:1178) according to the present invention is supported by 38 libraries. The number of libraries was determined as previously described. This segment can be found in the following transcript(s): H38804_PEA_1_T8 (SEQ ID NO:30). Table 255 below describes the starting and ending position of this segment on each transcript.

TABLE 255

Segment location on transcripts

| Transcript name | Segment starting position | Segment ending position |
|---|---|---|
| H38804_PEA_1_T8 (SEQ ID NO: 30) | 2018 | 2607 |

Segment cluster H38804_PEA_1_node_29 (SEQ ID NO:1179) according to the present invention is supported by 259 libraries. The number of libraries was determined as previously described. This segment can be found in the following transcript(s): H38804_PEA_1_T24 (SEQ ID NO:29) and H38804_PEA_1_T8 (SEQ ID NO:30). Table 256 below describes the starting and ending position of this segment on each transcript.

TABLE 256

Segment location on transcripts

| Transcript name | Segment starting position | Segment ending position |
|---|---|---|
| H38804_PEA_1_T24 (SEQ ID NO: 29) | 1617 | 2844 |
| H38804_PEA_1_T8 (SEQ ID NO: 30) | 2608 | 3835 |

Segment cluster H38804_PEA_1_node_30 (SEQ ID NO:1180) according to the present invention is supported by 169 libraries. The number of libraries was determined as previously described. This segment can be found in the following transcript(s): H38804_PEA_1_T24 (SEQ ID NO:29) and H38804_PEA_1_T8 (SEQ ID NO:30). Table 257 below describes the starting and ending position of this segment on each transcript.

TABLE 257

Segment location on transcripts

| Transcript name | Segment starting position | Segment ending position |
|---|---|---|
| H38804_PEA_1_T24 (SEQ ID NO: 29) | 2845 | 3170 |
| H38804_PEA_1_T8 (SEQ ID NO: 30) | 3836 | 4161 |

According to an optional embodiment of the present invention, short segments related to the above cluster are also provided. These segments are up to about 120 bp in length, and so are included in a separate description.

Segment cluster H38804_PEA_1_node_10 (SEQ ID NO:1181) according to the present invention is supported by 179 libraries. The number of libraries was determined as previously described. This segment can be found in the following transcript(s): H38804_PEA_1_T24 (SEQ ID NO:29) and H38804_PEA_1_T8 (SEQ ID NO:30). Table 258 below describes the starting and ending position of this segment on each transcript.

TABLE 258

Segment location on transcripts

| Transcript name | Segment starting position | Segment ending position |
|---|---|---|
| H38804_PEA_1_T24 (SEQ ID NO: 29) | 841 | 910 |
| H38804_PEA_1_T8 (SEQ ID NO: 30) | 841 | 910 |

Segment cluster H38804_PEA_1_node_12 (SEQ ID NO:1182) according to the present invention is supported by 181 libraries. The number of libraries was determined as previously described. This segment can be found in the following transcript(s): H38804_PEA_1_T24 (SEQ ID NO:29) and H38804_PEA_1_T8 (SEQ ID NO:30). Table 259 below describes the starting and ending position of this segment on each transcript.

TABLE 259

Segment location on transcripts

| Transcript name | Segment starting position | Segment ending position |
|---|---|---|
| H38804_PEA_1_T24 (SEQ ID NO: 29) | 911 | 949 |
| H38804_PEA_1_T8 (SEQ ID NO: 30) | 911 | 949 |

Segment cluster H38804_PEA_1_node_13 (SEQ ID NO:1183) according to the present invention is supported by 187 libraries. The number of libraries was determined as previously described. This segment can be found in the following transcript(s): H38804_PEA_1_T24 (SEQ ID NO:29) and H38804_PEA_1_T8 (SEQ ID NO:30). Table 260 below describes the starting and ending position of this segment on each transcript.

TABLE 260

Segment location on transcripts

| Transcript name | Segment starting position | Segment ending position |
|---|---|---|
| H38804_PEA_1_T24 (SEQ ID NO: 29) | 950 | 1028 |
| H38804_PEA_1_T8 (SEQ ID NO: 30) | 950 | 1028 |

Segment cluster H38804_PEA_1_node_14 (SEQ ID NO:1184) according to the present invention is supported by 179 libraries. The number of libraries was determined as previously described. This segment can be found in the following transcript(s): H38804_PEA_1_T24 (SEQ ID NO:29) and H38804_PEA_1_T8 (SEQ ID NO:30). Table 261 below describes the starting and ending position of this segment on each transcript.

TABLE 261

Segment location on transcripts

| Transcript name | Segment starting position | Segment ending position |
|---|---|---|
| H38804_PEA_1_T24 (SEQ ID NO: 29) | 1029 | 1062 |
| H38804_PEA_1_T8 (SEQ ID NO: 30) | 1029 | 1062 |

Segment cluster H38804_PEA_1_node_2 (SEQ ID NO:1185) according to the present invention is supported by 156 libraries. The number of libraries was determined as previously described. This segment can be found in the following transcript(s): H38804_PEA_1_T24 (SEQ ID NO:29) and H38804_PEA_1_T8 (SEQ ID NO:30). Table 262 below describes the starting and ending position of this segment on each transcript.

TABLE 262

Segment location on transcripts

| Transcript name | Segment starting position | Segment ending position |
|---|---|---|
| H38804_PEA_1_T24 (SEQ ID NO: 29) | 646 | 678 |
| H38804_PEA_1_T8 (SEQ ID NO: 30) | 646 | 678 |

Segment cluster H38804_PEA_1_node_20 (SEQ ID NO:1186) according to the present invention is supported by 162 libraries. The number of libraries was determined as previously described. This segment can be found in the following transcript(s): H38804_PEA_1_T24 (SEQ ID NO:29) and H38804_PEA_1_T8 (SEQ ID NO:30). Table 263 below describes the starting and ending position of this segment on each transcript.

TABLE 263

Segment location on transcripts

| Transcript name | Segment starting position | Segment ending position |
|---|---|---|
| H38804_PEA_1_T24 (SEQ ID NO: 29) | 1361 | 1399 |

TABLE 263-continued

Segment location on transcripts

| Transcript name | Segment starting position | Segment ending position |
|---|---|---|
| H38804_PEA_1_T8 (SEQ ID NO: 30) | 1361 | 1399 |

Segment cluster H38804_PEA_1_node_23 (SEQ ID NO:1187) according to the present invention can be found in the following transcript(s): H38804_PEA_1_T24 (SEQ ID NO:29) and H38804_PEA_1_T8 (SEQ ID NO:30). Table 264 below describes the starting and ending position of this segment on each transcript.

TABLE 264

Segment location on transcripts

| Transcript name | Segment starting position | Segment ending position |
|---|---|---|
| H38804_PEA_1_T24 (SEQ ID NO: 29) | 1400 | 1420 |
| H38804_PEA_1_T8 (SEQ ID NO: 30) | 1400 | 1420 |

Segment cluster H38804_PEA_1_node_26 (SEQ ID NO:1188) according to the present invention is supported by 21 libraries. The number of libraries was determined as previously described. This segment can be found in the following transcript(s): H38804_PEA_1_T8 (SEQ ID NO:30). Table 265 below describes the starting and ending position of this segment on each transcript.

TABLE 265

Segment location on transcripts

| Transcript name | Segment starting position | Segment ending position |
|---|---|---|
| H38804_PEA_1_T8 (SEQ ID NO: 30) | 1970 | 2017 |

Segment cluster H38804_PEA_1_node_3 (SEQ ID NO:1189) according to the present invention is supported by 162 libraries. The number of libraries was determined as previously described. This segment can be found in the following transcript(s): H38804_PEA_1_T24 (SEQ ID NO:29) and H38804_PEA_1_T8 (SEQ ID NO:30). Table 266 below describes the starting and ending position of this segment on each transcript.

TABLE 266

Segment location on transcripts

| Transcript name | Segment starting position | Segment ending position |
|---|---|---|
| H38804_PEA_1_T24 (SEQ ID NO: 29) | 679 | 716 |
| H38804_PEA_1_T8 (SEQ ID NO: 30) | 679 | 716 |

Segment cluster H38804_PEA_1_node_4 (SEQ ID NO:1190) according to the present invention is supported by 172 libraries. The number of libraries was determined as previously described. This segment can be found in the following transcript(s): H38804_PEA_1_T24 (SEQ ID NO:29) and H38804_PEA_1_T8 (SEQ ID NO:30). Table 267 below describes the starting and ending position of this segment on each transcript.

TABLE 267

Segment location on transcripts

| Transcript name | Segment starting position | Segment ending position |
|---|---|---|
| H38804_PEA_1_T24 (SEQ ID NO: 29) | 717 | 827 |
| H38804_PEA_1_T8 (SEQ ID NO: 30) | 717 | 827 |

Segment cluster H38804_PEA_1_node_5 (SEQ ID NO:1191) according to the present invention can be found in the following transcript(s): H38804_PEA_1_T24 (SEQ ID NO:29) and H38804_PEA_1_T8 (SEQ ID NO:30). Table 268 below describes the starting and ending position of this segment on each transcript.

TABLE 268

Segment location on transcripts

| Transcript name | Segment starting position | Segment ending position |
|---|---|---|
| H38804_PEA_1_T24 (SEQ ID NO: 29) | 828 | 840 |
| H38804_PEA_1_T8 (SEQ ID NO: 30) | 828 | 840 |

Variant Protein Alignment to the Previously Known Protein:
Sequence name: /tmp/RR40V8zYLg/QlORqeqpIp: BUB3_HUMAN (SEQ ID NO:1424)
Sequence documentation:
Alignment of: H38804_PEA_1_P5 (SEQ ID NO:1307) x BUB3_HUMAN (SEQ ID NO:1424) ..
Alignment segment 1/1:

| Quality: | 3244.00 | Escore: | 0 |
|---|---|---|---|
| Matching length: | 324 | Total length: | 324 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 58  MTGSNEFKLNQPPEDGISSVKFSPNTSQFLLVSSWDTSVRLYDVPANSMR  107
     ||||||||||||||||||||||||||||||||||||||||||||||||||
  1  MTGSNEFKLNQPPEDGISSVKFSPNTSQFLLVSSWDTSVRLYDVPANSMR   50

108  LKYQHTGAVLDCAFYDPTHAWSGGLDHQLKMHDLNTDQENLVGTHDAPIR  157
     ||||||||||||||||||||||||||||||||||||||||||||||||||
 51  LKYQHTGAVLDCAFYDPTHAWSGGLDHQLKMHDLNTDQENLVGTHDAPIR  100

158  CVEYCPEVNVMVTGSWDQTVKLWDPRTPCNAGTFSQPEKVYTLSVSGDRL  207
     ||||||||||||||||||||||||||||||||||||||||||||||||||
101  CVEYCPEVNVMVTGSWDQTVKLWDPRTPCNAGTFSQPEKVYTLSVSGDRL  150

208  IVGTAGRRVLVWDLRNMGYVQQRRESSLKYQTRCIRAFPNKQGYVLSSIE  257
     ||||||||||||||||||||||||||||||||||||||||||||||||||
151  IVGTAGRRVLVWDLRNMGYVQQRRESSLKYQTRCIRAFPNKQGYVLSSIE  200

258  GRVAVEYLDPSPEVQKKKYAFKCHRLKENNIEQIYPVNAISFHNIHNTFA  307
     ||||||||||||||||||||||||||||||||||||||||||||||||||
201  GRVAVEYLDPSPEVQKKKYAFKCHRLKENNIEQIYPVNAISFHNIHNTFA  250

308  TGGSDGFVNIWDPFNKKRLCQFHRYPTSIASLAFSNDGTTLAIASSYMYE  357
     ||||||||||||||||||||||||||||||||||||||||||||||||||
251  TGGSDGFVNIWDPFNKKRLCQFHRYPTSIASLAFSNDGTTLAIASSYMYE  300

358  MDDTEHPEDGIFIRQVTDAETKPK                            381
     ||||||||||||||||||||||||
301  MDDTEHPEDGIFIRQVTDAETKPK                            324
```

Sequence name: /tmp/Db0dQEpSuo/Lr8HPXaeBg: BUB3_HUMAN (SEQ ID NO:1424)

Sequence documentation:

Alignment of: H38804_PEA__1_P17 (SEQ ID NO:1308) x BUB3_HUMAN (SEQ ID NO:1424) ..

Alignment segment 1/1:

| | | | |
|---|---|---|---|
| Quality: | 3288.00 | Escore: | 0 |
| Matching length: | 328 | Total length: | 328 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 58  MTGSNEFKLNQPPEDGISSVKFSPNTSQFLLVSSWDTSVRLYDVPANSMR  107
     ||||||||||||||||||||||||||||||||||||||||||||||||||
  1  MTGSNEFKLNQPPEDGISSVKFSPNTSQFLLVSSWDTSVRLYDVPANSMR   50

108  LKYQHTGAVLDCAFYDPTHAWSGGLDHQLKMHDLNTDQENLVGTHDAPIR  157
     ||||||||||||||||||||||||||||||||||||||||||||||||||
 51  LKYQHTGAVLDCAFYDPTHAWSGGLDHQLKMHDLNTDQENLVGTHDAPIR  100

158  CVEYCPEVNVMVTGSWDQTVKLWDPRTPCNAGTFSQPEKVYTLSVSGDRL  207
     ||||||||||||||||||||||||||||||||||||||||||||||||||
101  CVEYCPEVNVMVTGSWDQTVKLWDPRTPCNAGTFSQPEKVYTLSVSGDRL  150

208  IVGTAGRRVLVWDLRNMGYVQQRRESSLKYQTRCIRAFPNKQGYVLSSIE  257
     ||||||||||||||||||||||||||||||||||||||||||||||||||
151  IVGTAGRRVLVWDLRNMGYVQQRRESSLKYQTRCIRAFPNKQGYVLSSIE  200

258  GRVAVEYLDPSPEVQKKKYAFKCHRLKENNIEQIYPVNAISFHNIHNTFA  307
     ||||||||||||||||||||||||||||||||||||||||||||||||||
201  GRVAVEYLDPSPEVQKKKYAFKCHRLKENNIEQIYPVNAISFHNIHNTFA  250

308  TGGSDGFVNIWDPFNKKRLCQFHRYPTSIASLAFSNDGTTLAIASSYMYE  357
     ||||||||||||||||||||||||||||||||||||||||||||||||||
251  TGGSDGFVNIWDPFNKKRLCQFHRYPTSIASLAFSNDGTTLAIASSYMYE  300

358  MDDTEHPEDGIFIRQVTDAETKPKSPCT                        385
     ||||||||||||||||||||||||||||
301  MDDTEHPEDGIFIRQVTDAETKPKSPCT                        328
```

Description for Cluster HSENA78

Cluster HSENA78 features 1 transcript(s) and 7 segment(s) of interest, the names for which are given in Tables 269 and 270, respectively, the sequences themselves are given at the end of the application. The selected protein variants are given in table 271.

TABLE 269

Transcripts of interest

| Transcript Name | Sequence ID No. |
|---|---|
| HSENA78_T5 | 31 |

TABLE 270

Segments of interest

| Segment Name | Sequence ID No. |
|---|---|
| HSENA78_node_0 | 398 |
| HSENA78_node_2 | 399 |
| HSENA78_node_6 | 400 |
| HSENA78_node_9 | 401 |
| HSENA78_node_3 | 402 |
| HSENA78_node_4 | 403 |
| HSENA78_node_8 | 404 |

TABLE 271

Proteins of interest

| Protein Name | Sequence ID No. |
|---|---|
| HSENA78_P2 | 1309 |

These sequences are variants of the known protein Small inducible cytokine B5 precursor (SwissProt accession identifier SZ05_HUMAN; known also according to the synonyms CXCL5; Epithelial-derived neutrophil activating protein 78; Neutrophil-activating peptide ENA-78), SEQ ID NO:1425, referred to herein as the previously known protein.

Protein Small inducible cytokine B5 precursor (SEQ ID NO:1425) is known or believed to have the following function(s): Involved in neutrophil activation. The sequence for protein Small inducible cytokine B5 precursor is given at the end of the application, as "Small inducible cytokine B5 precursor amino acid sequence". Protein Small inducible cytokine B5 precursor localization is believed to be Secreted.

The following GO Annotation(s) apply to the previously known protein. The following annotation(s) were found: chemotaxis; signal transduction; cell-cell signaling; positive control of cell proliferation, which are annotation(s) related to Biological Process; and chemokine, which are annotation(s) related to Molecular Function.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/Locus-Link/>.

Cluster HSENA78 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 24 refer to weighted expression of ESTs in each category, as "parts per million" (ratio of the expression of ESTs for a particular cluster to the expression of all ESTs in that category, according to parts per million).

Figure 24:
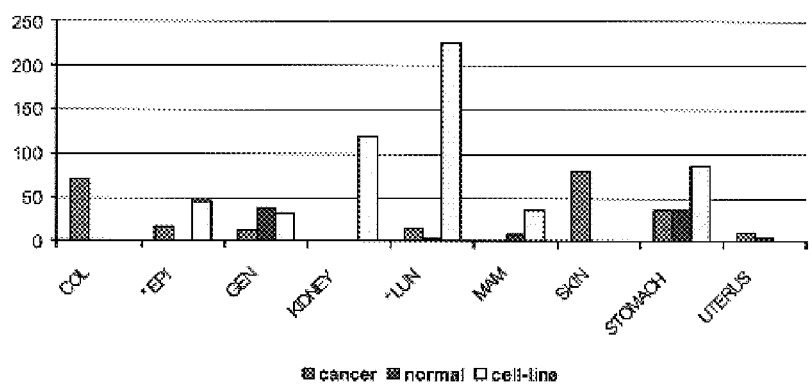
FIG. 24 is a histogram showing Cancer and cell-line vs. normal tissue expression for Cluster HSENA78, demonstrating overexpression in epithelial malignant tumors and lung malignant tumors.

Overall, the following results were obtained as shown with regard to the histograms in FIG. 24 and Table 272. This cluster is overexpressed (at least at a minimum level) in the following pathological conditions: epithelial malignant tumors and lung malignant tumors.

TABLE 272

Normal tissue distribution

| Name of Tissue | Number |
|---|---|
| colon | 0 |
| epithelial | 2 |
| general | 38 |
| kidney | 0 |
| lung | 3 |
| breast | 8 |
| skin | 0 |
| stomach | 36 |
| uterus | 4 |

TABLE 273

P values and ratios for expression in cancerous tissue

| Name of Tissue | P1 | P2 | SP1 | R3 | SP2 | R4 |
|---|---|---|---|---|---|---|
| colon | 2.6e−01 | 3.3e−01 | 1.7e−01 | 2.7 | 2.7e−01 | 2.2 |
| epithelial | 2.5e−01 | 9.0e−02 | 3.2e−03 | 4.1 | 8.5e−07 | 5.5 |
| general | 8.4e−01 | 7.2e−01 | 1 | 0.3 | 1 | 0.4 |
| kidney | 1 | 7.2e−01 | 1 | 1.0 | 1.7e−01 | 1.9 |
| lung | 8.5e−01 | 4.8e−01 | 4.1e−01 | 1.9 | 4.0e−05 | 3.8 |
| breast | 9.5e−01 | 8.7e−01 | 1 | 0.8 | 6.8e−01 | 1.2 |
| skin | 2.9e−01 | 4.7e−01 | 1.4e−01 | 7.0 | 6.4e−01 | 1.6 |
| stomach | 5.0e−01 | 4.3e−01 | 7.5e−01 | 1.0 | 4.3e−01 | 1.3 |
| uterus | 7.1e−01 | 8.5e−01 | 6.6e−01 | 1.3 | 8.0e−01 | 1.0 |

As noted above, cluster HSENA78 features 1 transcript(s), which were listed in Table 269 above. These transcript(s) encode for protein(s) which are variant(s) of protein Small inducible cytokine B5 precursor (SEQ ID NO:1425). A description of each variant protein according to the present invention is now provided.

Variant protein HSENA78_P2 (SEQ ID NO:1309) according to the present invention has an amino acid sequence as given at the end of the application; it is encoded by transcript(s) HSENA78_T5 (SEQ ID NO:31). An alignment is given to the known protein (Small inducible cytokine B5 precursor (SEQ ID NO:1425)) at the end of the application. One or more alignments to one or more previously published protein sequences are given at the end of the application. A brief description of the relationship of the variant protein according to the present invention to each such aligned protein is as follows:

Comparison Report Between HSENA78_P2 (SEQ ID NO:1309) and SZ05_HUMAN (SEQ ID NO:1425):

1. An isolated chimeric polypeptide encoding for HSENA78_P2 (SEQ ID NO:1309), comprising a first amino acid sequence being at least 90% homologous to MSLLSS-RAARVPGPSSSLCALLVLLLLLTQPGPI-ASAGPAAAVLRELRCVCLQTTQGVHP KMISNLQV-FAIGPQCSKVEVV corresponding to amino acids 1-81 of SZ05_HUMAN (SEQ ID NO:1425), which also corresponds to amino acids 1-81 of HSENA78_P2 (SEQ ID NO:1309).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSENA78_P2 (SEQ ID NO:1309) also has the following non-silent SNPs (Single Nucleotide Polymorphisms) as listed in Table 274, (given according to their position(s) on the amino acid sequence, with the alternative amino acid(s) listed; the last column indicates whether the SNP is known or not; the presence of known SNPs in variant protein HSENA78_P2 (SEQ ID NO:1309) sequence provides support for the deduced sequence of this variant protein according to the present invention).

TABLE 274

Amino acid mutations

| SNP position(s) on amino acid sequence | Alternative amino acid(s) | Previously known SNP? |
|---|---|---|
| 80 | V -> | No |
| 81 | V -> | No |

Variant protein HSENA78_P2 (SEQ ID NO:1309) is encoded by the following transcript(s): HSENA78_T5 (SEQ ID NO:31), for which the sequence(s) is/are given at the end of the application. The coding portion of transcript HSENA78_T5 (SEQ ID NO:31) is shown in bold; this coding portion starts at position 149 and ends at position 391. The transcript also has the following SNPs as listed in Table 275 (given according to their position on the nucleotide sequence, with the alternative nucleic acid listed; the last column indicates whether the SNP is known or not; the presence of known SNPs in variant protein HSENA78_P2 (SEQ ID NO:1309) sequence provides support for the deduced sequence of this variant protein according to the present invention).

TABLE 275

Nucleic acid SNPs

| SNP position on nucleotide sequence | Alternative nucleic acid | Previously known SNP? |
|---|---|---|
| 92 | C -> T | Yes |
| 144 | C -> T | No |
| 1151 | A -> T | Yes |
| 1389 | T -> C | No |
| 1867 | C -> G | Yes |
| 145 | C -> T | No |
| 181 | C -> T | Yes |
| 316 | G -> A | Yes |
| 388 | G -> | No |
| 390 | T -> | No |
| 605 | T -> | No |
| 972 | C -> T | Yes |
| 1105 | A -> G | Yes |

As noted above, cluster HSENA78 features 7 segment(s), which were listed in Table 270 above and for which the sequence(s) are given at the end of the application. These segment(s) are portions of nucleic acid sequence(s) which are described herein separately because they are of particular interest. A description of each segment according to the present invention is now provided.

Segment cluster HSENA78_node_0 (SEQ ID NO:1192) according to the present invention is supported by 24 libraries. The number of libraries was determined as previously described. This segment can be found in the following transcript(s): HSENA78_T5 (SEQ ID NO:31). Table 276 below describes the starting and ending position of this segment on each transcript.

TABLE 276

Segment location on transcripts

| Transcript name | Segment starting position | Segment ending position |
|---|---|---|
| HSENA78_T5 (SEQ ID NO: 31) | 1 | 257 |

Segment cluster HSENA78_node_2 (SEQ ID NO:1193) according to the present invention is supported by 22 libraries. The number of libraries was determined as previously described. This segment can be found in the following transcript(s): HSENA78_T5 (SEQ ID NO:31). Table 277 below describes the starting and ending position of this segment on each transcript.

TABLE 277

Segment location on transcripts

| Transcript name | Segment starting position | Segment ending position |
|---|---|---|
| HSENA78_T5 (SEQ ID NO: 31) | 258 | 390 |

Segment cluster HSENA78_node_6 (SEQ ID NO:1194) according to the present invention is supported by 68 libraries. The number of libraries was determined as previously described. This segment can be found in the following transcript(s): HSENA78_T5 (SEQ ID NO:31). Table 278 below describes the starting and ending position of this segment on each transcript.

TABLE 278

Segment location on transcripts

| Transcript name | Segment starting position | Segment ending position |
|---|---|---|
| HSENA78_T5 (SEQ ID NO: 31) | 585 | 2370 |

Segment cluster HSENA78_node_9 (SEQ ID NO:1195) according to the present invention is supported by 28 libraries. The number of libraries was determined as previously described. This segment can be found in the following transcript(s): HSENA78_T5 (SEQ ID NO:31). Table 279 below describes the starting and ending position of this segment on each transcript.

TABLE 279

Segment location on transcripts

| Transcript name | Segment starting position | Segment ending position |
|---|---|---|
| HSENA78_T5 (SEQ ID NO: 31) | 2394 | 2546 |

According to an optional embodiment of the present invention, short segments related to the above cluster are also provided. These segments are up to about 120 bp in length, and so are included in a separate description.

Segment cluster HSENA78_node_3 (SEQ ID NO:1196) according to the present invention is supported by 1 libraries. The number of libraries was determined as previously described. This segment can be found in the following transcript(s): HSENA78_T5 (SEQ ID NO:31). Table 280 below describes the starting and ending position of this segment on each transcript.

TABLE 280

Segment location on transcripts

| Transcript name | Segment starting position | Segment ending position |
|---|---|---|
| HSENA78_T5 (SEQ ID NO: 31) | 391 | 500 |

Segment cluster HSENA78_node_4 (SEQ ID NO:1197) according to the present invention is supported by 17 libraries. The number of libraries was determined as previously described. This segment can be found in the following transcript(s): HSENA78_T5 (SEQ ID NO:31). Table 281 below describes the starting and ending position of this segment on each transcript.

TABLE 281

Segment location on transcripts

| Transcript name | Segment starting position | Segment ending position |
|---|---|---|
| HSENA78_T5 (SEQ ID NO: 31) | 501 | 584 |

Segment cluster HSENA78_node_8 (SEQ ID NO:1198) according to the present invention can be found in the following transcript(s): HSENA78_T5 (SEQ ID NO:31). Table 282 below describes the starting and ending position of this segment on each transcript.

TABLE 282

Segment location on transcripts

| Transcript name | Segment starting position | Segment ending position |
|---|---|---|
| HSENA78_T5 (SEQ ID NO: 31) | 2371 | 2393 |

Variant Protein Alignment to the Previously Known Protein:

Sequence name: /tmp/5kiQY6MxWx/pLnTrxsCqk: SZ05_HUMAN (SEQ ID NO:1425)

Sequence documentation:

Alignment of: HSENA78_P2 (SEQ ID NO:1309) x SZ05_HUMAN (SEQ ID NO:1425) ..

Alignment segment 1/1:

| | | | |
|---|---|---|---|
| Quality: | 767.00 | Escore: | 0 |
| Matching length: | 81 | Total length: | 81 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MSLLSSRAARVPGPSSSLCALLVLLLLLTQPGPIASAGPAAAVLRELRCV  50
    |||||||||||||||||||||||||||||||||||||||||||||||||
 1  MSLLSSRAARVPGPSSSLCALLVLLLLLTQPGPIASAGPAAAVLRELRCV  50

51  CLQTTQGVHPKMISNLQVFAIGPQCSKVEVV  81
    |||||||||||||||||||||||||||||||
51  CLQTTQGVHPKMISNLQVFAIGPQCSKVEVV  81
```

Description for Cluster HUMODCA

Cluster HUMODCA features 1 transcript(s) and 17 segment(s) of interest, the names for which are given in Tables 283 and 284, respectively, the sequences themselves are given at the end of the application. The selected protein variants are given in table 285.

TABLE 283

Transcripts of interest

| Transcript Name | Sequence ID No. |
|---|---|
| HUMODCA_T17 | 32 |

TABLE 284

Segments of interest

| Segment Name | Sequence ID No. |
| --- | --- |
| HUMODCA_node_1 | 405 |
| HUMODCA_node_25 | 406 |
| HUMODCA_node_32 | 407 |
| HUMODCA_node_36 | 408 |
| HUMODCA_node_39 | 409 |
| HUMODCA_node_41 | 410 |
| HUMODCA_node_0 | 411 |
| HUMODCA_node_10 | 412 |
| HUMODCA_node_12 | 413 |
| HUMODCA_node_13 | 414 |
| HUMODCA_node_2 | 415 |
| HUMODCA_node_27 | 416 |
| HUMODCA_node_3 | 417 |
| HUMODCA_node_30 | 418 |
| HUMODCA_node_34 | 419 |
| HUMODCA_node_38 | 420 |
| HUMODCA_node_40 | 421 |

TABLE 285

Proteins of interest

| Protein Name | Sequence ID No. |
| --- | --- |
| HUMODCA_P9 | 1310 |

These sequences are variants of the known protein Ornithine decarboxylase (SwissProt accession identifier DCOR_HUMAN; known also according to the synonyms EC 4.1.1.17; ODC), SEQ ID NO: 1426, referred to herein as the previously known protein.

Protein Ornithine decarboxylase (SEQ ID NO:1426) is known or believed to have the following function(s): Polyamine biosynthesis; first (rate-limiting) step. The sequence for protein Ornithine decarboxylase (SEQ ID NO:1426) is given at the end of the application, as "Ornithine decarboxylase (SEQ ID NO:1426) amino acid sequence". Known polymorphisms for this sequence are as shown in Table 286.

TABLE 286

Amino acid mutations for Known Protein

| SNP position(s) on amino acid sequence | Comment |
| --- | --- |
| 415 | Q -> E |

The following GO Annotation(s) apply to the previously known protein. The following annotation(s) were found: polyamine biosynthesis, which are annotation(s) related to Biological Process; and ornithine decarboxylase; lyase, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster HUMODCA can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 25 refer to weighted expression of ESTs in each category, as "parts per million" (ratio of the expression of ESTs for a particular cluster to the expression of all ESTs in that category, according to parts per million).

Figure 25:
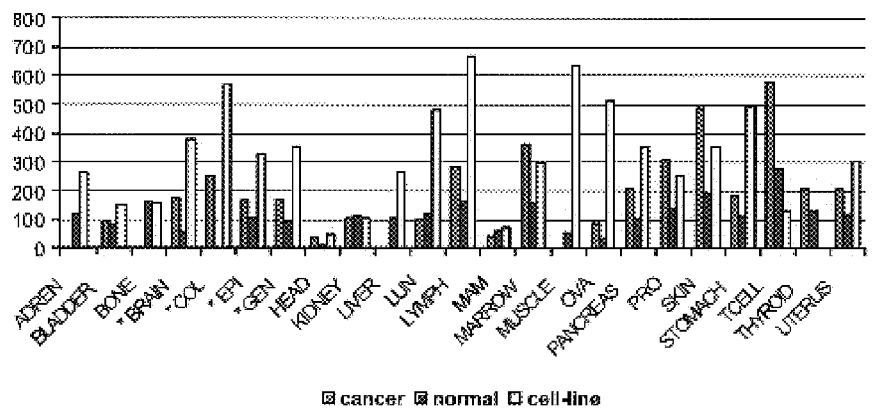
FIG. 25 is a histogram showing Cancer and cell-line vs. normal tissue expression for Cluster HUMODCA, demonstrating overexpression in: brain malignant tumors, colorectal cancer, epithelial malignant tumors and a mixture of malignant tumors from different tissues.

Overall, the following results were obtained as shown with regard to the histograms in FIG. 25 and Table 287. This cluster is overexpressed (at least at a minimum level) in the following pathological conditions: brain malignant tumors, colorectal cancer, epithelial malignant tumors and a mixture of malignant tumors from different tissues.

TABLE 287

Normal tissue distribution

| Name of Tissue | Number |
| --- | --- |
| adrenal | 120 |
| bladder | 82 |
| bone | 161 |
| brain | 53 |
| colon | 0 |
| epithelial | 107 |
| general | 94 |
| head and neck | 10 |
| kidney | 114 |
| liver | 107 |
| lung | 120 |
| lymph nodes | 165 |
| breast | 61 |
| bone marrow | 156 |
| muscle | 55 |
| ovary | 36 |
| pancreas | 102 |
| prostate | 140 |
| skin | 188 |
| stomach | 109 |
| T cells | 278 |
| Thyroid | 128 |
| uterus | 118 |

TABLE 288

P values and ratios for expression in cancerous tissue

| Name of Tissue | P1 | P2 | SP1 | R3 | SP2 | R4 |
| --- | --- | --- | --- | --- | --- | --- |
| adrenal | 8.3e-01 | 7.8e-01 | 1 | 0.2 | 8.5e-01 | 0.7 |
| bladder | 5.4e-01 | 5.1e-01 | 6.2e-01 | 1.1 | 5.0e-01 | 1.1 |
| bone | 8.3e-01 | 3.2e-01 | 1 | 0.2 | 8.4e-01 | 0.7 |
| brain | 2.6e-01 | 3.8e-01 | 6.5e-04 | 2.8 | 8.7e-10 | 3.6 |
| colon | 2.2e-02 | 5.8e-03 | 1.5e-03 | 6.9 | 6.7e-05 | 9.9 |
| epithelial | 6.4e-02 | 2.7e-03 | 1.4e-03 | 1.5 | 1.6e-12 | 2.1 |
| general | 1.3e-03 | 5.4e-08 | 1.9e-08 | 1.7 | 1.4e-39 | 2.6 |
| head and neck | 1.7e-01 | 1.7e-01 | 1 | 1.2 | 7.5e-01 | 1.3 |
| kidney | 7.7e-01 | 7.6e-01 | 7.1e-01 | 0.8 | 6.6e-01 | 0.9 |
| liver | 7.3e-01 | 5.7e-01 | 1 | 0.3 | 2.4e-01 | 1.2 |
| lung | 7.8e-01 | 5.8e-01 | 7.6e-01 | 0.6 | 7.3e-04 | 1.7 |
| lymph nodes | 3.9e-01 | 2.5e-01 | 1.8e-01 | 1.1 | 1.4e-04 | 2.1 |
| breast | 7.8e-01 | 4.7e-01 | 7.7e-01 | 0.8 | 6.4e-01 | 1.0 |
| bone marrow | 3.4e-01 | 2.6e-01 | 2.8e-01 | 2.1 | 1.6e-01 | 1.2 |
| muscle | 8.5e-01 | 6.1e-01 | 1 | 0.2 | 7.1e-05 | 1.0 |
| ovary | 1.7e-01 | 9.3e-02 | 3.8e-01 | 1.7 | 2.2e-02 | 2.6 |
| pancreas | 2.2e-01 | 3.2e-01 | 5.7e-02 | 1.6 | 6.6e-03 | 1.5 |
| prostate | 5.0e-01 | 4.9e-01 | 3.8e-02 | 1.9 | 4.5e-02 | 1.7 |
| skin | 6.2e-01 | 5.8e-01 | 5.4e-02 | 0.9 | 1.5e-02 | 0.5 |
| stomach | 4.2e-01 | 2.6e-01 | 3.7e-01 | 0.7 | 7.3e-03 | 2.3 |
| T cells | 1 | 1 | 5.5e-01 | 1.5 | 8.1e-01 | 0.9 |
| Thyroid | 8.3e-02 | 8.3e-02 | 5.9e-01 | 1.3 | 5.9e-01 | 1.3 |
| uterus | 4.2e-01 | 2.4e-01 | 1.6e-01 | 1.2 | 4.9e-02 | 1.7 |

As noted above, cluster HUMODCA features 1 transcript(s), which were listed in Table 283 above. These transcript(s) encode for protein(s) which are variant(s) of protein Ornithine decarboxylase (SEQ ID NO:1426). A description of each variant protein according to the present invention is now provided.

Variant protein HUMODCA_P9 (SEQ ID NO:1310) according to the present invention has an amino acid sequence as given at the end of the application; it is encoded by transcript(s) HUMODCA_T17 (SEQ ID NO:32). An alignment is given to the known protein (Ornithine decarboxylase (SEQ ID NO:1426)) at the end of the application. One or more alignments to one or more previously published protein sequences are given at the end of the application. A brief description of the relationship of the variant protein according to the present invention to each such aligned protein is as follows:

Comparison Report Between HUMODCA_P9 (SEQ ID NO:1310) and DCOR_HUMAN (SEQ ID NO:1426):

1. An isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLLPRTF-WTRKLMKFLLL (SEQ ID NO: 1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFV QAIS-DARCVFDMGAEVGFSMYLLDIGGGFPGSEDVKLKF EEITGVINPALDKYFPSDSG VRIIAEPGRYYVASAFT-LAVNIIAKKIVLKEQTGSDDEDESSEQT-FMYYVNDGVYGSFN CILYDHAHVKPLLQKRPKPDE-KYYSSSIWGPTCDGLDRIVERCDLPEMHVGDWML FEN MGAYTVAAASTFNGFQRPTIYYVMSG-PAWQLMQQFQNPDFPPEVEEQDASTLPVSCA WESG-MKRHRAACASASINV corresponding to amino acids 151-461 of DCOR_HUMAN (SEQ ID NO:1426), which also corresponds to amino acids 30-340 of HUMODCA_P9 (SEQ ID NO:1310), wherein said first and second amino acid sequences are contiguous and in a sequential order.

2. An isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMKFLLL (SEQ ID NO: 1768) of HUMODCA_P9 (SEQ ID NO:1310).

Comparison Report Between HUMODCA_P9 (SEQ ID NO:1310) and AAA59968 (SEQ ID NO:1702):

1. An isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLLPRTF-WTRKLMKFLLL (SEQ ID NO: 1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFV QAIS-DARCVFDMGAEVGFSMYLLDIGGGFPG-SEDVKLKFEEITGVINPALDKYFPSDSG VRII-AEPGRYYVASAFTLAVNIIAKKIV-LKEQTGSDDEDESSEQTFMYYVNDGVYGSFN CILYDHAHVKPLLQKRPKPDEKYYSSSI-WGPTCDGLDRIVERCDLPEMHVGDWMLFEN MGAY-TVAAASTFNGFQRPTIYYVMSGPAWQLM-QQFQNPDFPPEVEEQDASTLPVSCA WESGMKRHRAACASASINV corresponding to amino acids 40-350 of AAA59968, which also corresponds to amino acids 30-340 of HUMODCA_P9 (SEQ ID NO:1310), wherein said first and second amino acid sequences are contiguous and in a sequential order.

2. An isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMKFLLL (SEQ ID NO: 1768) of HUMODCA_P9 (SEQ ID NO:1310).

Comparison Report Between HUMODCA_P9 (SEQ ID NO:1310) and AAH14562 (SEQ ID NO:1703):

1. An isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLLPRTF-WTRKLMKFLLL (SEQ ID NO: 1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFV QAIS-DARCVFDMGAEVGFSMYLLDIGGGFPGSEDVKLKF EEITGVINPALDKYFPSDSG VRIIAEPGRYYVASAFT-LAVNIIAKKIVLKEQTGSDDEDESSEQT-FMYYVNDGVYGSFN CILYDHAHVKPLLQKRPKPDE-KYYSSSIWGPTCDGLDRIVERCDLPEMHVGDWMLF EN MGAYTVAAASTFNGFQRPTIYYVMSG-PAWQLMQQFQNPDFPPEVEEQDASTLPVSCA WESG-MKRHRAACASASINV corresponding to amino acids 86-396 of AAH14562 (SEQ ID NO:1703), which also corresponds to amino acids 30-340 of HUMODCA_P9 (SEQ ID NO:1310), wherein said first and second amino acid sequences are contiguous and in a sequential order.

2. An isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMKFLLL (SEQ ID NO: 1768) of HUMODCA_P9 (SEQ ID NO:1310).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMODCA_P9 (SEQ ID NO:1310) also has the following non-silent SNPs (Single Nucleotide Polymorphisms) as listed in Table 289, (given according to their position(s) on the amino acid sequence, with the alternative amino acid(s) listed; the last column indicates whether the SNP is known or not; the presence of known SNPs in variant protein HUMODCA_P9 (SEQ ID NO:1310) sequence provides support for the deduced sequence of this variant protein according to the present invention).

TABLE 289

Amino acid mutations

| SNP position(s) on amino acid sequence | Alternative amino acid(s) | Previously known SNP? |
|---|---|---|
| 150 | I -> S | No |
| 150 | I -> V | No |
| 262 | F -> L | No |
| 263 | E -> | No |
| 263 | E -> G | No |
| 30 | L -> | No |
| 301 | N -> | No |
| 301 | N -> K | No |
| 309 | E -> K | No |
| 312 | D -> N | No |
| 323 | E -> K | No |
| 329 | H -> P | No |
| 174 | I -> | No |
| 34 | I -> | No |
| 59 | L -> | No |
| 70 | V -> | No |
| 86 | T -> | No |
| 86 | T -> N | No |
| 90 | A -> | No |
| 94 | A -> | No |
| 97 | V -> | No |
| 97 | V -> G | No |
| 198 | N -> D | No |
| 200 | G -> | No |
| 3 | S -> | No |
| 207 | C -> G | No |
| 207 | C -> R | No |
| 223 | P -> | No |
| 262 | F -> | No |

Variant protein HUMODCA_P9 (SEQ ID NO:1310) is encoded by the following transcript(s): HUMODCA_T17 (SEQ ID NO:32), for which the sequence(s) is/are given at the end of the application. The coding portion of transcript HUMODCA_T17 (SEQ ID NO:32) is shown in bold; this coding portion starts at position 528 and ends at position 1547. The transcript also has the following SNPs as listed in Table 290 (given according to their position on the nucleotide sequence, with the alternative nucleic acid listed; the last column indicates whether the SNP is known or not; the presence of known SNPs in variant protein HUMODCA_P9 (SEQ ID NO:1310) sequence provides support for the deduced sequence of this variant protein according to the present invention).

TABLE 290

Nucleic acid SNPs

| SNP position on nucleotide sequence | Alternative nucleic acid | Previously known SNP? |
|---|---|---|
| 28 | C -> G | Yes |
| 210 | C -> | No |
| 536 | T -> | No |
| 615 | T -> | No |
| 628 | T -> | No |
| 703 | T -> | No |
| 736 | T -> | No |
| 784 | C -> | No |
| 784 | C -> A | No |
| 797 | A -> | No |
| 797 | A -> T | No |
| 808 | C -> | No |
| 217 | C -> | No |
| 817 | T -> | No |
| 817 | T -> G | No |
| 869 | C -> T | Yes |
| 975 | A -> G | No |

TABLE 290-continued

Nucleic acid SNPs

| SNP position on nucleotide sequence | Alternative nucleic acid | Previously known SNP? |
|---|---|---|
| 976 | T -> G | No |
| 1048 | T -> | No |
| 1119 | A -> G | No |
| 1127 | C -> | No |
| 1127 | C -> G | No |
| 1146 | T -> C | No |
| 366 | G -> C | No |
| 1146 | T -> G | No |
| 1194 | C -> | No |
| 1283 | T -> C | Yes |
| 1311 | T -> | No |
| 1311 | T -> C | No |
| 1315 | A -> | No |
| 1315 | A -> G | No |
| 1430 | C -> | No |
| 1430 | C -> A | No |
| 1433 | C -> G | No |
| 366 | G -> T | No |
| 1433 | C -> T | Yes |
| 1452 | G -> A | No |
| 1461 | G -> A | No |
| 1494 | G -> A | No |
| 1513 | A -> C | No |
| 1632 | T -> | No |
| 1673 | C -> | No |
| 1739 | T -> | No |
| 1739 | T -> G | No |
| 1742 | T -> C | No |
| 447 | G -> A | Yes |
| 1786 | C -> | No |
| 1786 | C -> G | No |
| 1832 | T -> C | Yes |
| 1877 | C -> T | No |
| 464 | T -> G | Yes |
| 473 | A -> G | Yes |
| 506 | G -> A | Yes |
| 521 | T -> | No |

As noted above, cluster HUMODCA features 17 segment(s), which were listed in Table 284 above and for which the sequence(s) are given at the end of the application. These segment(s) are portions of nucleic acid sequence(s) which are described herein separately because they are of particular interest. A description of each segment according to the present invention is now provided.

Segment cluster HUMODCA_node_1 (SEQ ID NO:1199) according to the present invention is supported by 76 libraries. The number of libraries was determined as previously described. This segment can be found in the following transcript(s): HUMODCA_T17 (SEQ ID NO:32). Table 291 below describes the starting and ending position of this segment on each transcript.

TABLE 291

Segment location on transcripts

| Transcript name | Segment starting position | Segment ending position |
|---|---|---|
| HUMODCA_T17 (SEQ ID NO: 32) | 118 | 256 |

Segment cluster HUMODCA_node_25 (SEQ ID NO:1200) according to the present invention is supported by 190 libraries. The number of libraries was determined as previously described. This segment can be found in the following transcript(s): HUMODCA_T17 (SEQ ID NO:32).

Table 292 below describes the starting and ending position of this segment on each transcript.

TABLE 292

Segment location on transcripts

| Transcript name | Segment starting position | Segment ending position |
|---|---|---|
| HUMODCA_T17 (SEQ ID NO: 32) | 614 | 748 |

Segment cluster HUMODCA_node_32 (SEQ ID NO:1201) according to the present invention is supported by 249 libraries. The number of libraries was determined as previously described. This segment can be found in the following transcript(s): HUMODCA_T17 (SEQ ID NO:32). Table 293 below describes the starting and ending position of this segment on each transcript.

TABLE 293

Segment location on transcripts

| Transcript name | Segment starting position | Segment ending position |
|---|---|---|
| HUMODCA_T17 (SEQ ID NO: 32) | 915 | 1077 |

Segment cluster HUMODCA_node_36 (SEQ ID NO:1202) according to the present invention is supported by 348 libraries. The number of libraries was determined as previously described. This segment can be found in the following transcript(s): HUMODCA_T17 (SEQ ID NO:32). Table 294 below describes the starting and ending position of this segment on each transcript.

TABLE 294

Segment location on transcripts

| Transcript name | Segment starting position | Segment ending position |
|---|---|---|
| HUMODCA_T17 (SEQ ID NO: 32) | 1191 | 1405 |

Segment cluster HUMODCA_node_39 (SEQ ID NO:1203) according to the present invention is supported by 297 libraries. The number of libraries was determined as previously described. This segment can be found in the following transcript(s): HUMODCA_T17 (SEQ ID NO:32). Table 295 below describes the starting and ending position of this segment on each transcript.

TABLE 295

Segment location on transcripts

| Transcript name | Segment starting position | Segment ending position |
|---|---|---|
| HUMODCA_T17 (SEQ ID NO: 32) | 1461 | 1633 |

Segment cluster HUMODCA_node_41 (SEQ ID NO:1204) according to the present invention is supported by 230 libraries. The number of libraries was determined as previously described. This segment can be found in the following transcript(s): HUMODCA_T17 (SEQ ID NO:32). Table 296 below describes the starting and ending position of this segment on each transcript.

TABLE 296

Segment location on transcripts

| Transcript name | Segment starting position | Segment ending position |
|---|---|---|
| HUMODCA_T17 (SEQ ID NO: 32) | 1728 | 1893 |

According to an optional embodiment of the present invention, short segments related to the above cluster are also provided. These segments are up to about 120 bp in length, and so are included in a separate description.

Segment cluster HUMODCA_node_0 (SEQ ID NO:1205) according to the present invention is supported by 9 libraries. The number of libraries was determined as previously described. This segment can be found in the following transcript(s): HUMODCA_T17 (SEQ ID NO:32). Table 297 below describes the starting and ending position of this segment on each transcript.

TABLE 297

Segment location on transcripts

| Transcript name | Segment starting position | Segment ending position |
|---|---|---|
| HUMODCA_T17 (SEQ ID NO: 32) | 1 | 117 |

Segment cluster HUMODCA_node_10 (SEQ ID NO:1206) according to the present invention is supported by 107 libraries. The number of libraries was determined as previously described. This segment can be found in the following transcript(s): HUMODCA_T17 (SEQ ID NO:32). Table 298 below describes the starting and ending position of this segment on each transcript.

TABLE 298

Segment location on transcripts

| Transcript name | Segment starting position | Segment ending position |
|---|---|---|
| HUMODCA_T17 (SEQ ID NO: 32) | 385 | 494 |

Segment cluster HUMODCA_node_12 (SEQ ID NO:1207) according to the present invention is supported by 132 libraries. The number of libraries was determined as previously described. This segment can be found in the following transcript(s): HUMODCA_T17 (SEQ ID NO:32). Table 299 below describes the starting and ending position of this segment on each transcript.

TABLE 299

Segment location on transcripts

| Transcript name | Segment starting position | Segment ending position |
|---|---|---|
| HUMODCA_T17 (SEQ ID NO: 32) | 495 | 586 |

Segment cluster HUMODCA_node_13 (SEQ ID NO:1208) according to the present invention is supported by 126 libraries. The number of libraries was determined as previously described. This segment can be found in the following transcript(s): HUMODCA_T17 (SEQ ID NO:32). Table 300 below describes the starting and ending position of this segment on each transcript.

TABLE 300

Segment location on transcripts

| Transcript name | Segment starting position | Segment ending position |
|---|---|---|
| HUMODCA_T17 (SEQ ID NO: 32) | 587 | 613 |

Segment cluster HUMODCA_node_2 (SEQ ID NO:1209) according to the present invention is supported by 81 libraries. The number of libraries was determined as previously described. This segment can be found in the following transcript(s): HUMODCA_T17 (SEQ ID NO:32). Table 301 below describes the starting and ending position of this segment on each transcript.

TABLE 301

Segment location on transcripts

| Transcript name | Segment starting position | Segment ending position |
|---|---|---|
| HUMODCA_T17 (SEQ ID NO: 32) | 257 | 328 |

Segment cluster HUMODCA_node_27 (SEQ ID NO:1210) according to the present invention is supported by 185 libraries. The number of libraries was determined as previously described. This segment can be found in the following transcript(s): HUMODCA_T17 (SEQ ID NO:32). Table 302 below describes the starting and ending position of this segment on each transcript.

TABLE 302

Segment location on transcripts

| Transcript name | Segment starting position | Segment ending position |
|---|---|---|
| HUMODCA_T17 (SEQ ID NO: 32) | 749 | 830 |

Segment cluster HUMODCA_node_3 (SEQ ID NO:1211) according to the present invention is supported by 85 libraries. The number of libraries was determined as previously described. This segment can be found in the following transcript(s): HUMODCA_T17 (SEQ ID NO:32). Table 303 below describes the starting and ending position of this segment on each transcript.

TABLE 303

Segment location on transcripts

| Transcript name | Segment starting position | Segment ending position |
|---|---|---|
| HUMODCA_T17 (SEQ ID NO: 32) | 329 | 384 |

Segment cluster HUMODCA_node_30 (SEQ ID NO:1212) according to the present invention is supported by 196 libraries. The number of libraries was determined as previously described. This segment can be found in the following transcript(s): HUMODCA_T17 (SEQ ID NO:32). Table 304 below describes the starting and ending position of this segment on each transcript.

TABLE 304

Segment location on transcripts

| Transcript name | Segment starting position | Segment ending position |
|---|---|---|
| HUMODCA_T17 (SEQ ID NO: 32) | 831 | 914 |

Segment cluster HUMODCA_node_34 (SEQ ID NO:1213) according to the present invention is supported by 259 libraries. The number of libraries was determined as previously described. This segment can be found in the following transcript(s): HUMODCA_T17 (SEQ ID NO:32). Table 305 below describes the starting and ending position of this segment on each transcript.

TABLE 305

Segment location on transcripts

| Transcript name | Segment starting position | Segment ending position |
|---|---|---|
| HUMODCA_T17 (SEQ ID NO: 32) | 1078 | 1190 |

Segment cluster HUMODCA_node_38 (SEQ ID NO:1214) according to the present invention is supported by 272 libraries. The number of libraries was determined as previously described. This segment can be found in the following transcript(s): HUMODCA_T17 (SEQ ID NO:32). Table 306 below describes the starting and ending position of this segment on each transcript.

TABLE 306

Segment location on transcripts

| Transcript name | Segment starting position | Segment ending position |
|---|---|---|
| HUMODCA_T17 (SEQ ID NO: 32) | 1406 | 1460 |

Segment cluster HUMODCA_node_40 (SEQ ID NO:1215) according to the present invention is supported by 239 libraries. The number of libraries was determined as previously described. This segment can be found in the following transcript(s): HUMODCA_T17 (SEQ ID NO:32). Table 307 below describes the starting and ending position of this segment on each transcript.

TABLE 307

Segment location on transcripts

| Transcript name | Segment starting position | Segment ending position |
|---|---|---|
| HUMODCA_T17 (SEQ ID NO: 32) | 1634 | 1727 |

Variant Protein Alignment to the Previously Known Protein:
Sequence name: /tmp/y03EwE6i01/dRQ512K6e2: DCOR_HUMAN (SEQ ID NO:1426)
Sequence documentation:

Alignment of: HUMODCA_P9 (SEQ ID NO:1310) x DCOR_HUMAN (SEQ ID NO:1426) ..

Alignment segment 1/1:

| | | | |
|---|---|---|---|
| Quality: | 3056.00 | Escore: | 0 |
| Matching length: | 311 | Total length: | 311 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 30  LVLRIATDDSKAVCRLSVKFGATLRTSRLLLERAKELNIDVVGVSFHVGS   79
     ||||||||||||||||||||||||||||||||||||||||||||||||||
151  LVLRIATDDSKAVCRLSVKFGATLRTSRLLLERAKELNIDVVGVSFHVGS  200

80  GCTDPETFVQAISDARCVFDMGAEVGFSMYLLDIGGGFPGSEDVKLKFEE  129
     ||||||||||||||||||||||||||||||||||||||||||||||||||
201  GCTDPETFVQAISDARCVFDMGAEVGFSMYLLDIGGGFPGSEDVKLKFEE  250

130  ITGVINPALDKYFPSDSGVRIIAEPGRYYVASAFTLAVNIIAKKIVLKEQ  179
     ||||||||||||||||||||||||||||||||||||||||||||||||||
251  ITGVINPALDKYFPSDSGVRIIAEPGRYYVASAFTLAVNIIAKKIVLKEQ  300

180  TGSDDEDESSEQTFMYYVNDGVYGSFNCILYDHAHVKPLLQKRPKPDEKY  229
     ||||||||||||||||||||||||||||||||||||||||||||||||||
301  TGSDDEDESSEQTFMYYVNDGVYGSFNCILYDHAHVKPLLQKRPKPDEKY  350

230  YSSSIWGPTCDGLDRIVERCDLPEMHVGDWMLFENMGAYTVAAASTFNGF  279
     ||||||||||||||||||||||||||||||||||||||||||||||||||
351  YSSSIWGPTCDGLDRIVERCDLPEMHVGDWMLFENMGAYTVAAASTFNGF  400

280  QRPTIYYVMSGPAWQLMQQFQNPDFPPEVEEQDASTLPVSCAWESGMKRH  329
     ||||||||||||||||||||||||||||||||||||||||||||||||||
401  QRPTIYYVMSGPAWQLMQQFQNPDFPPEVEEQDASTLPVSCAWESGMKRH  450

330  RAACASASINV                                        340
     |||||||||||
451  RAACASASINV                                        461
```

Sequence name: /tmp/y03EwE6i01/dRQ512K6e2: AAA59968

Sequence documentation:

Alignment of: HUMODCA_P9 (SEQ ID NO:1310) x AAA59968 ..

Alignment segment 1/1:

| | | | |
|---|---|---|---|
| Quality: | 3056.00 | Escore: | 0 |
| Matching length: | 311 | Total length: | 311 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 30   LVLRIATDDSKAVCRLSVKFGATLRTSRLLLERAKELNIDVVGVSFHVGS   79
      ||||||||||||||||||||||||||||||||||||||||||||||||||
 40   LVLRIATDDSKAVCRLSVKFGATLRTSRLLLERAKELNIDVVGVSFHVGS   89

80   GCTDPETFVQAISDARCVFDMGAEVGFSMYLLDIGGGFPGSEDVKLKFEE  129
      ||||||||||||||||||||||||||||||||||||||||||||||||||
 90   GCTDPETFVQAISDARCVFDMGAEVGFSMYLLDIGGGFPGSEDVKLKFEE  139

130   ITGVINPALDKYFPSDSGVRIIAEPGRYYVASAFTLAVNIIAKKIVLKEQ  179
      ||||||||||||||||||||||||||||||||||||||||||||||||||
140   ITGVINPALDKYFPSDSGVRIIAEPGRYYVASAFTLAVNIIAKKIVLKEQ  189

180   TGSDDEDESSEQTFMYYVNDGVYGSFNCILYDHAHVKPLLQKRPKPDEKY  229
      ||||||||||||||||||||||||||||||||||||||||||||||||||
190   TGSDDEDESSEQTFMYYVNDGVYGSFNCILYDHAHVKPLLQKRPKPDEKY  239

230   YSSSIWGPTCDGLDRIVERCDLPEMHVGDWMLFENMGAYTVAAASTFNGF  279
      ||||||||||||||||||||||||||||||||||||||||||||||||||
240   YSSSIWGPTCDGLDRIVERCDLPEMHVGDWMLFENMGAYTVAAASTFNGF  289

280   QRPTIYYVMSGPAWQLMQQFQNPDFPPEVEEQDASTLPVSCAWESGMKRH  329
      ||||||||||||||||||||||||||||||||||||||||||||||||||
290   QRPTIYYVMSGPAWQLMQQFQNPDFPPEVEEQDASTLPVSCAWESGMKRH  339

330   RAACASASINV                                        340
      |||||||||||
340   RAACASASINV                                        350
```

Sequence name: /tmp/y03EwE6i01/dRQ512K6e2: AAH14562 (SEQ ID NO:1703)

Sequence documentation:

Alignment of: HUMODCA_P9 (SEQ ID NO:1310) x AAH14562 (SEQ ID NO:1703) ..

Alignment segment 1/1:

| | | | |
|---|---|---|---|
| Quality: | 3056.00 | Escore: | 0 |
| Matching length: | 311 | Total length: | 311 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
30   LVLRIATDDSKAVCRLSVKFGATLRTSRLLLERAKELNIDVVGVSFHVGS   79
     ||||||||||||||||||||||||||||||||||||||||||||||||||
86   LVLRIATDDSKAVCRLSVKFGATLRTSRLLLERAKELNIDVVGVSFHVGS   135

80   GCTDPETFVQAISDARCVFDMGAEVGFSMYLLDIGGGFPGSEDVKLKFEE   129
     |||||||||||||||||||||||||||||||||||||||||||||||||
136  GCTDPETFVQAISDARCVFDMGAEVGFSMYLLDIGGGFPGSEDVKLKFEE   185

130  ITGVINPALDKYFPSDSGVRIIAEPGRYYVASAFTLAVNIIAKKIVLKEQ   179
     |||||||||||||||||||||||||||||||||||||||||||||||||
186  ITGVINPALDKYFPSDSGVRIIAEPGRYYVASAFTLAVNIIAKKIVLKEQ   235

180  TGSDDEDESSEQTFMYYVNDGVYGSFNCILYDHAHVKPLLQKRPKPDEKY   229
     |||||||||||||||||||||||||||||||||||||||||||||||||
236  TGSDDEDESSEQTFMYYVNDGVYGSFNCILYDHAHVKPLLQKRPKPDEKY   285

230  YSSSIWGPTCDGLDRIVERCDLPEMHVGDWMLFENMGAYTVAAASTFNGF   279
     |||||||||||||||||||||||||||||||||||||||||||||||||
286  YSSSIWGPTCDGLDRIVERCDLPEMHVGDWMLFENMGAYTVAAASTFNGF   335

280  QRPTIYYVMSGPAWQLMQQFQNPDFPPEVEEQDASTLPVSCAWESGMKRH   329
     |||||||||||||||||||||||||||||||||||||||||||||||||
336  QRPTIYYVMSGPAWQLMQQFQNPDFPPEVEEQDASTLPVSCAWESGMKRH   385

330  RAACASASINV   340
     |||||||||||
386  RAACASASINV   396
```

Description for Cluster R00299

Cluster R00299 features 1 transcript(s) and 12 segment(s) of interest, the names for which are given in Tables 308 and 309, respectively, the sequences themselves are given at the end of the application. The selected protein variants are given in table 310.

TABLE 308

Transcripts of interest

| Transcript Name | Sequence ID No. |
|---|---|
| R00299_T2 | 33 |

TABLE 309

Segments of interest

| Segment Name | Sequence ID No. |
|---|---|
| R00299_node_2 | 422 |
| R00299_node_30 | 423 |
| R00299_node_10 | 424 |
| R00299_node_14 | 425 |
| R00299_node_15 | 426 |
| R00299_node_20 | 427 |
| R00299_node_23 | 428 |
| R00299_node_25 | 429 |
| R00299_node_28 | 430 |
| R00299_node_31 | 431 |
| R00299_node_5 | 432 |
| R00299_node_9 | 433 |

TABLE 310

Proteins of interest

| Protein Name | Sequence ID No. |
|---|---|
| R00299_P3 | 1311 |

These sequences are variants of the known protein Tescalcin (SwissProt accession identifier TESC_HUMAN; known also according to the synonyms TSC), SEQ ID NO:1427, referred to herein as the previously known protein.

Protein Tescalcin (SEQ ID NO:1427) is known or believed to have the following function(s): Binds calcium. The sequence for protein Tescalcin is given at the end of the application, as "Tescalcin amino acid sequence".

The following GO Annotation(s) apply to the previously known protein. The following annotation(s) were found: calcium binding, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster R00299 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 26 below refer to weighted expression of ESTs in each category, as "parts per million" (ratio of the expression of ESTs for a particular cluster to the expression of all ESTs in that category, according to parts per million).

Figure 26:
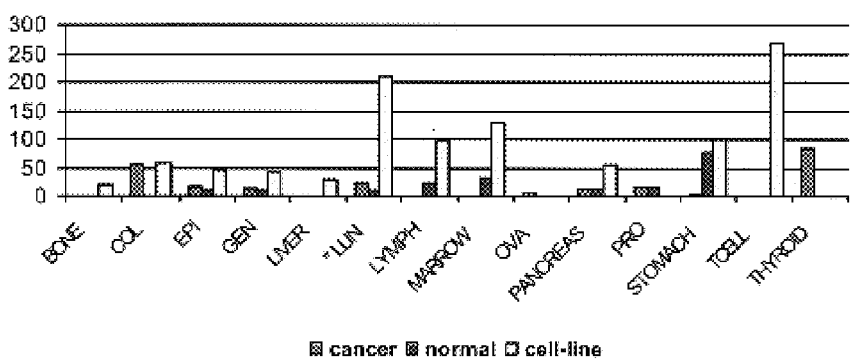
FIG. 26 is a histogram showing Cancer and cell-line vs. normal tissue expression for Cluster R00299, demonstrating overexpression in lung malignant tumors.

Overall, the following results were obtained as shown with regard to the histograms in FIG. 26 and Table 311. This cluster is overexpressed (at least at a minimum level) in the following pathological conditions: lung malignant tumors.

TABLE 311

Normal tissue distribution

| Name of Tissue | Number |
|---|---|
| bone | 0 |
| colon | 0 |
| epithelial | 11 |
| general | 11 |
| liver | 0 |
| lung | 10 |
| lymph nodes | 22 |
| bone marrow | 31 |
| ovary | 0 |
| pancreas | 14 |
| prostate | 16 |
| stomach | 76 |
| T cells | 0 |
| Thyroid | 0 |

TABLE 312

P values and ratios for expression in cancerous tissue

| Name of Tissue | P1 | P2 | SP1 | R3 | SP2 | R4 |
|---|---|---|---|---|---|---|
| bone | 1 | 6.7e−01 | 1 | 1.0 | 7.0e−01 | 1.4 |
| colon | 5.0e−02 | 5.3e−02 | 2.4e−01 | 2.8 | 2.1e−01 | 2.8 |
| epithelial | 7.7e−02 | 9.5e−02 | 4.0e−01 | 1.3 | 6.1e−03 | 1.9 |
| general | 2.3e−01 | 2.6e−01 | 5.3e−01 | 1.0 | 2.6e−04 | 1.9 |
| liver | 1 | 4.5e−01 | 1 | 1.0 | 6.9e−01 | 1.5 |
| lung | 4.9e−01 | 2.7e−01 | 6.5e−01 | 1.7 | 5.6e−04 | 3.8 |
| lymph nodes | 8.5e−01 | 8.7e−01 | 1 | 0.5 | 2.0e−01 | 1.1 |
| bone marrow | 8.6e−01 | 8.5e−01 | 1 | 0.5 | 2.3e−01 | 1.4 |
| ovary | 4.0e−01 | 4.4e−01 | 1 | 1.1 | 1 | 1.1 |
| pancreas | 7.2e−01 | 6.9e−01 | 6.7e−01 | 1.0 | 3.5e−01 | 1.5 |
| prostate | 8.7e−01 | 9.1e−01 | 6.7e−01 | 1.0 | 7.5e−01 | 0.9 |
| stomach | 6.6e−01 | 7.5e−01 | 1 | 0.4 | 6.7e−01 | 0.7 |
| T cells | 1 | 6.7e−01 | 1 | 1.0 | 5.2e−01 | 1.8 |
| Thyroid | 1.8e−01 | 1.8e−01 | 6.7e−01 | 1.6 | 6.7e−01 | 1.6 |

As noted above, cluster R00299 features 1 transcript(s), which were listed in Table 308 above. These transcript(s) encode for protein(s) which are variant(s) of protein Tescalcin (SEQ ID NO:1427). A description of each variant protein according to the present invention is now provided.

Variant protein R00299_P3 (SEQ ID NO:1311) according to the present invention has an amino acid sequence as given at the end of the application; it is encoded by transcript(s) R00299_T2 (SEQ ID NO:33). An alignment is given to the known protein (Tescalcin (SEQ ID NO:1427)) at the end of the application. One or more alignments to one or more previously published protein sequences are given at the end of the application. A brief description of the relationship of the variant protein according to the present invention to each such aligned protein is as follows:

Comparison Report Between R00299_P3 (SEQ ID NO:1311) and Q9NWT9 (SEQ ID NO:1704):

1. An isolated chimeric polypeptide encoding for R00299_P3 (SEQ ID NO: 1311), comprising a first amino acid sequence being at least 70%, optionally at least 80%, preferably at least 85%, more preferably at least 90% and most preferably at least 95% homologous to a polypeptide having the sequence MAEKALLCPSSAGLGTWPWVLN-SAWPVLPLAVDQGVDWRPRGPV (SEQ ID NO:1769) corresponding to amino acids 1-44 of R00299_P3 (SEQ ID NO:1311), second amino acid sequence being at least 90% homologous to SSDQIEQLHRRFKQLSGDQPTIRKEN-FNNVPDLELNPIRSKIVRAFFDNRNLRKGPSGLA DEINFEDFLTIMSYFRPIDTTMDEEQV-ELSRKEKLRFLFHMYDSDSDGRITLEEYRNV corresponding to amino acids 74-191 of Q9NWT9 (SEQ ID NO:1704), which also corresponds to amino acids 45-162 of R00299_P3 (SEQ ID NO:1311), and a third amino acid sequence being at least 70%, optionally at least 80%, preferably at least 85%, more preferably at least 90% and most preferably at least 95% homologous to a polypeptide having the sequence VEELLSGNPHIEKESARSIADGAM-MEAASVCMGQMEPDQVYEGITFEDFLKIWQGIDIE TKMHVRFLNMETMALCH (SEQ ID NO:1770) corresponding to amino acids 163-238 of R00299_P3 (SEQ ID NO:1311), wherein said first, second and third amino acid sequences are contiguous and in a sequential order.

2. An isolated polypeptide encoding for a head of R00299_P3 (SEQ ID NO:1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPVL-PLAVDQGVDWRPRGPV (SEQ ID NO:1769) of R00299_P3 (SEQ ID NO:1311).

3. An isolated polypeptide encoding for a tail of R00299_P3 (SEQ ID NO:1311), comprising a polypeptide being at least 70%, optionally at least about 80%, preferably at least about 85%, more preferably at least about 90% and most preferably at least about 95% homologous to the sequence VEELLSGNPHIEKESARSIADGAM-MEAASVCMGQMEPDQVYEGITFEDFLKIWQGIDIE TKMHVRFLNMETMALCH (SEQ ID NO:1770) in R00299_P3 (SEQ ID NO:1311).

Comparison Report Between R00299_P3 (SEQ ID NO:1311) and TESC_HUMAN (SEQ ID NO:1427):

1. An isolated chimeric polypeptide encoding for R00299_P3 (SEQ ID NO:1311), comprising a first amino acid sequence being at least 70%, optionally at least 80%, preferably at least 85%, more preferably at least 90% and most preferably at least 95% homologous to a polypeptide having the sequence MAEKALLCPSSAGLGTWPWVLN-SAWPVLPLAVDQGVDWRPRGPV (SEQ ID NO:1769) corresponding to amino acids 1-44 of R00299_P3 (SEQ ID NO:1311), and a second amino acid sequence being at least 90% homologous to SSDQIEQLHRRFKQLSGDQP-TIRKENFNNVPDLELNPIRSKIVRAFFD-NRNLRKGPSGLA DEINFEDFLTIMSYFRPIDTTMDE-EQVELSRKEKLRFLFHMYDSDSDGRITLEEYRNVVE ELLSGNPHIEKESARSIADGAMMEAAS-VCMGQMEPDQVYEGITFEDFLKIWQGIDIETK MHVRFLNMETMALCH (SEQ ID NO: 1770) corresponding to amino acids 21-214 of TESC_HUMAN (SEQ ID NO:1427), which also corresponds to amino acids 45-238 of R00299_P3 (SEQ ID NO:1311), wherein said first and second amino acid sequences are contiguous and in a sequential order.

2. An isolated polypeptide encoding for a head of R00299_P3 (SEQ ID NO:1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPVL-PLAVDQGVDWRPRGPV (SEQ ID NO:1769) of R00299_P3 (SEQ ID NO:1311).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide,NN:NO) predicts that this protein has a signal peptide.

Variant protein R00299_P3 (SEQ ID NO:1311) also has the following non-silent SNPs (Single Nucleotide Polymorphisms) as listed in Table 313, (given according to their position(s) on the amino acid sequence, with the alternative amino acid(s) listed; the last column indicates whether the SNP is known or not; the presence of known SNPs in variant protein R00299_P3 (SEQ ID NO:1311) sequence provides support for the deduced sequence of this variant protein according to the present invention).

TABLE 313

Amino acid mutations

| SNP position(s) on amino acid sequence | Alternative amino acid(s) | Previously known SNP? |
|---|---|---|
| 120 | R -> G | No |
| 120 | R -> W | No |

Variant protein R00299_P3 (SEQ ID NO:1311) is encoded by the following transcript(s): R00299_T2 (SEQ ID NO:33), for which the sequence(s) is/are given at the end of the application. The coding portion of transcript R00299_T2 (SEQ ID NO:33) is shown in bold; this coding portion starts at position 142 and ends at position 855. The transcript also has the following SNPs as listed in Table 314 (given according to their position on the nucleotide sequence, with the alternative nucleic acid listed; the last column indicates whether the SNP is known or not; the presence of known SNPs in variant protein R00299_P3 (SEQ ID NO:1311) sequence provides support for the deduced sequence of this variant protein according to the present invention).

TABLE 314

Nucleic acid SNPs

| SNP position on nucleotide sequence | Alternative nucleic acid | Previously known SNP? |
|---|---|---|
| 177 | C -> A | Yes |
| 499 | C -> G | No |
| 499 | C -> T | No |
| 900 | G -> T | Yes |
| 916 | G -> | No |
| 969 | G -> | No |
| 969 | G -> A | No |
| 987 | A -> C | No |

As noted above, cluster R00299 features 12 segment(s), which were listed in Table 309 above and for which the sequence(s) are given at the end of the application. These segment(s) are portions of nucleic acid sequence(s) which are described herein separately because they are of particular interest. A description of each segment according to the present invention is now provided.

Segment cluster R00299_node_2 (SEQ ID NO:1216) according to the present invention is supported by 3 libraries. The number of libraries was determined as previously described. This segment can be found in the following transcript(s): R00299 T2 (SEQ ID NO:33). Table 315 below describes the starting and ending position of this segment on each transcript.

TABLE 315

Segment location on transcripts

| Transcript name | Segment starting position | Segment ending position |
|---|---|---|
| R00299_T2 (SEQ ID NO: 33) | 1 | 271 |

Segment cluster R00299_node_30 (SEQ ID NO:1217) according to the present invention is supported by 75 libraries. The number of libraries was determined as previously described. This segment can be found in the following transcript(s): R00299_T2 (SEQ ID NO:33). Table 316 below describes the starting and ending position of this segment on each transcript.

TABLE 316

Segment location on transcripts

| Transcript name | Segment starting position | Segment ending position |
|---|---|---|
| R00299_T2 (SEQ ID NO: 33) | 790 | 961 |

According to an optional embodiment of the present invention, short segments related to the above cluster are also provided. These segments are up to about 120 bp in length, and so are included in a separate description.

Segment cluster R00299_node_10 (SEQ ID NO:1218) according to the present invention is supported by 46 libraries. The number of libraries was determined as previously described. This segment can be found in the following transcript(s): R00299_T2 (SEQ ID NO:33). Table 317 below describes the starting and ending position of this segment on each transcript.

TABLE 317

Segment location on transcripts

| Transcript name | Segment starting position | Segment ending position |
|---|---|---|
| R00299_T2 (SEQ ID NO: 33) | 346 | 422 |

Segment cluster R00299_node_14 (SEQ ID NO:1219) according to the present invention is supported by 61 libraries. The number of libraries was determined as previously described. This segment can be found in the following transcript(s): R00299_T2 (SEQ ID NO:33). Table 318 below describes the starting and ending position of this segment on each transcript.

TABLE 318

Segment location on transcripts

| Transcript name | Segment starting position | Segment ending position |
|---|---|---|
| R00299_T2 (SEQ ID NO: 33) | 423 | 537 |

Segment cluster R00299_node_15 (SEQ ID NO:1220) according to the present invention can be found in the following transcript(s): R00299_T2 (SEQ ID NO:33). Table 319 below describes the starting and ending position of this segment on each transcript.

TABLE 319

Segment location on transcripts

| Transcript name | Segment starting position | Segment ending position |
|---|---|---|
| R00299_T2 (SEQ ID NO: 33) | 538 | 562 |

Segment cluster R00299_node_20 (SEQ ID NO:1221) according to the present invention is supported by 66 libraries. The number of libraries was determined as previously described. This segment can be found in the following transcript(s): R00299_T2 (SEQ ID NO:33). Table 320 below describes the starting and ending position of this segment on each transcript.

TABLE 320

Segment location on transcripts

| Transcript name | Segment starting position | Segment ending position |
|---|---|---|
| R00299_T2 (SEQ ID NO: 33) | 563 | 624 |

Segment cluster R00299_node_23 (SEQ ID NO:1222) according to the present invention is supported by 71 libraries. The number of libraries was determined as previously described. This segment can be found in the following transcript(s): R00299_T2 (SEQ ID NO:33). Table 321 below describes the starting and ending position of this segment on each transcript.

TABLE 321

Segment location on transcripts

| Transcript name | Segment starting position | Segment ending position |
|---|---|---|
| R00299_T2 (SEQ ID NO: 33) | 625 | 732 |

Segment cluster R00299_node_25 (SEQ ID NO:1223) according to the present invention is supported by 62 libraries. The number of libraries was determined as previously described. This segment can be found in the following transcript(s): R00299_T2 (SEQ ID NO:33). Table 322 below describes the starting and ending position of this segment on each transcript.

TABLE 322

Segment location on transcripts

| Transcript name | Segment starting position | Segment ending position |
|---|---|---|
| R00299_T2 (SEQ ID NO: 33) | 733 | 780 |

Segment cluster R00299_node_28 (SEQ ID NO:1224) according to the present invention can be found in the following transcript(s): R00299_T2 (SEQ ID NO:33). Table 323 below describes the starting and ending position of this segment on each transcript.

TABLE 323

Segment location on transcripts

| Transcript name | Segment starting position | Segment ending position |
|---|---|---|
| R00299_T2 (SEQ ID NO: 33) | 781 | 789 |

Segment cluster R00299_node_31 (SEQ ID NO:1225) according to the present invention is supported by 48 libraries. The number of libraries was determined as previously described. This segment can be found in the following transcript(s): R00299_T2 (SEQ ID NO:33). Table 324 below describes the starting and ending position of this segment on each transcript.

TABLE 324

Segment location on transcripts

| Transcript name | Segment starting position | Segment ending position |
|---|---|---|
| R00299_T2 (SEQ ID NO: 33) | 962 | 1069 |

Segment cluster R00299_node_5 (SEQ ID NO:1226) according to the present invention is supported by 45 libraries. The number of libraries was determined as previously described. This segment can be found in the following transcript(s): R00299_T2 (SEQ ID NO:33). Table 325 below describes the starting and ending position of this segment on each transcript.

TABLE 325

Segment location on transcripts

| Transcript name | Segment starting position | Segment ending position |
|---|---|---|
| R00299_T2 (SEQ ID NO: 33) | 272 | 341 |

Segment cluster R00299_node_9 (SEQ ID NO:1227) according to the present invention can be found in the following transcript(s): R00299_T2 (SEQ ID NO:33). Table 326 below describes the starting and ending position of this segment on each transcript.

TABLE 326

Segment location on transcripts

| Transcript name | Segment starting position | Segment ending position |
|---|---|---|
| R00299_T2 (SEQ ID NO: 33) | 342 | 345 |

Microarray (chip) data is also available for this gene as follows. As described above with regard to the cluster itself, various oligonucleotides were tested for being differentially expressed in various disease conditions, particularly cancer. The following oligonucleotide was found to hit this segment (with regard to lung cancer), shown in Table 327.

TABLE 327

Oligonucleotide related to this gene

| Oligonucleotide name | Overexpressed in cancers | Chip reference |
|---|---|---|
| R00299_0_8_0 | lung cancer | Lung |

Variant Protein Alignment to the Previously Known Protein:
Sequence name: /tmp/OleVDhrKQ0/EjblgLomjM:Q9NWT9 (SEQ ID NO:1704)

Sequence documentation:
Alignment of: R00299_P3 (SEQ ID NO:1311) x Q9NWT9 (SEQ ID NO:1704) ..

Alignment segment 1/1:

| | | | |
|---|---|---|---|
| Quality: | 1162.00 | Escore: | 0 |
| Matching length: | 118 | Total length: | 118 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 45  SSDQIEQLHRRFKQLSGDQPTIRKENFNNVPDLELNPIRSKIVRAFFDNR   94
     ||||||||||||||||||||||||||||||||||||||||||||||||||
 74  SSDQIEQLHRRFKQLSGDQPTIRKENFNNVPDLELNPIRSKIVRAFFDNR  123

95  NLRKGPSGLADEINFEDFLTIMSYFRPIDTTMDEEQVELSRKEKLRFLFH  144
     ||||||||||||||||||||||||||||||||||||||||||||||||||
124  NLRKGPSGLADEINFEDFLTIMSYFRPIDTTMDEEQVELSRKEKLRFLFH  173

145  MYDSDSDGRITLEEYRNV                                 162
     ||||||||||||||||||
174  MYDSDSDGRITLEEYRNV                                 191
```

Sequence name: /tmp/OleVDhrKQ0/EjblgLomjM:TESC_HUMAN (SEQ ID NO:1427)

Sequence documentation:

Alignment of: R00299_P3 (SEQ ID NO:1311) x TESC_HUMAN (SEQ ID NO:1427) ..

Alignment segment 1/1:

| | | | |
|---|---|---|---|
| Quality: | 1920.00 | Escore: | 0 |
| Matching length: | 194 | Total length: | 194 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
45   SSDQIEQLHRRFKQLSGDQPTIRKENFNNVPDLELNPIRSKIVRAFFDNR    94
     ||||||||||||||||||||||||||||||||||||||||||||||||||
21   SSDQIEQLHRRFKQLSGDQPTIRKENFNNVPDLELNPIRSKIVRAFFDNR    70

95   NLRKGPSGLADEINFEDFLTIMSYFRPIDTTMDEEQVELSRKEKLRFLFH    144
     |||||||||||||||||||||||||||||||||||||||||||||||||
71   NLRKGPSGLADEINFEDFLTIMSYFRPIDTTMDEEQVELSRKEKLRFLFH    120

145  MYDSDSDGRITLEEYRNVVEELLSGNPHIEKESARSIADGAMMEAASVCM    194
     |||||||||||||||||||||||||||||||||||||||||||||||||
121  MYDSDSDGRITLEEYRNVVEELLSGNPHIEKESARSIADGAMMEAASVCM    170

195  GQMEPDQVYEGITFEDFLKIWQGIDIETKMHVRFLNMETMALCH          238
     |||||||||||||||||||||||||||||||||||||||||||
171  GQMEPDQVYEGITFEDFLKIWQGIDIETKMHVRFLNMETMALCH          214
```

Description for Cluster W60282

Cluster W60282 features 1 transcript(s) and 6 segment(s) of interest, the names for which are given in Tables 328 and 329, respectively, the sequences themselves are given at the end of the application. The selected protein variants are given in table 330.

TABLE 328

Transcripts of interest

| Transcript Name | Sequence ID No. |
|---|---|
| W60282_PEA_1_T11 | 34 |

TABLE 329

Segments of interest

| Segment Name | Sequence ID No. |
|---|---|
| W60282_PEA_1_node_10 | 434 |
| W60282_PEA_1_node_18 | 435 |
| W60282_PEA_1_node_22 | 436 |
| W60282_PEA_1_node_5 | 437 |
| W60282_PEA_1_node_21 | 438 |
| W60282_PEA_1_node_8 | 439 |

TABLE 330

Proteins of interest

| Protein Name | Sequence ID No. |
|---|---|
| W60282_PEA_1_P14 | 1312 |

These sequences are variants of the known protein Kallikrein 11 precursor (SwissProt accession identifier KLK-B_HUMAN; known also according to the synonyms EC 3.4.21.-; Hippostasin; Trypsin-like protease), SEQ ID NO: 1428, referred to herein as the previously known protein.

Protein Kallikrein 11 precursor (SEQ ID NO:1428) is known or believed to have the following function(s): Possible multifunctional protease. Efficiently cleaves bz-Phe-Arg-4-methylcoumaryl-7-amide, a kallikrein substrate, and weakly cleaves other substrates for kallikrein and trypsin. The sequence for protein Kallikrein 11 precursor is given at the end of the application, as "Kallikrein 11 precursor amino acid sequence". Protein Kallikrein 11 precursor localization is believed to be Secreted.

The following GO Annotation(s) apply to the previously known protein. The following annotation(s) were found: proteolysis and peptidolysis, which are annotation(s) related to Biological Process; and chymotrypsin; trypsin; serine-type peptidase; hydrolase, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

As noted above, cluster W60282 features 1 transcript(s), which were listed in Table 1 above. These transcript(s) encode for protein(s) which are variant(s) of protein Kallikrein 11 precursor (SEQ ID NO:1428). A description of each variant protein according to the present invention is now provided.

Variant protein W60282_PEA_1_P14 (SEQ ID NO:1312) according to the present invention has an amino acid sequence as given at the end of the application; it is encoded by transcript(s) W60282_PEA_1_T11 (SEQ ID NO:34). An alignment is given to the known protein (Kallikrein 11 precursor (SEQ ID NO:1428)) at the end of the application. One or more alignments to one or more previously published protein sequences are given at the end of the application. A brief description of the relationship of the variant protein according to the present invention to each such aligned protein is as follows:

Comparison Report Between W60282_PEA_1_P14 (SEQ ID NO:1312) and Q81XD7 (SEQ ID NO:1705):

1. An isolated chimeric polypeptide encoding for W60282_PEA_1_P14 (SEQ ID NO:1312), comprising a first amino acid sequence being at least 90% homologous to MRILQLILLALATGLVGGETRIIKG-FECKPHSQPWQAALFEKTRLLCGATLIAPRWLLTA AHCLKP corresponding to amino acids 1-66 of Q81XD7 (SEQ ID NO:1705), which also corresponds to amino acids 1-66 of W60282_PEA_1_P14 (SEQ ID NO:1312), and a second amino acid sequence being at least 70%, optionally at least 80%, preferably at least 85%, more preferably at least 90% and most preferably at least 95% homologous to a polypeptide having the sequence TPASHLAMRQHHHH (SEQ ID NO:1771) corresponding to amino acids 67-80 of W60282_PEA_1_P14 (SEQ ID NO:1312), wherein said first and second amino acid sequences are contiguous and in a sequential order.

2. An isolated polypeptide encoding for a tail of W60282_PEA_1_P14 (SEQ ID NO:1312), comprising a polypeptide being at least 70%, optionally at least about 80%, preferably at least about 85%, more preferably at least about 90% and most preferably at least about 95% homologous to the sequence TPASHLAMRQHHHH (SEQ ID NO: 1771) in W60282_PEA_1_P14 (SEQ ID NO:1312).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein W60282_PEA_1_P14 (SEQ ID NO:1312) also has the following non-silent SNPs (Single Nucleotide Polymorphisms) as listed in Table 331, (given according to their position(s) on the amino acid sequence, with the alternative amino acid(s) listed; the last column indicates whether the SNP is known or not; the presence of known SNPs in variant protein W60282_PEA_1_P14 (SEQ ID NO:1312) sequence provides support for the deduced sequence of this variant protein according to the present invention).

TABLE 331

| | Amino acid mutations | |
|---|---|---|
| SNP position(s) on amino acid sequence | Alternative amino acid(s) | Previously known SNP? |
| 17 | G -> E | Yes |
| 41 | E -> K | No |

Variant protein W60282_PEA_1_P14 (SEQ ID NO:1312) is encoded by the following transcript(s): W60282_PEA_1_T11 (SEQ ID NO:34), for which the sequence(s) is/are given at the end of the application. The coding portion of transcript W60282_PEA_1_T11 (SEQ ID NO:34) is shown in bold; this coding portion starts at position 705 and ends at position 944. The transcript also has the following SNPs as listed in Table 332 (given according to their position on the nucleotide sequence, with the alternative nucleic acid listed; the last column indicates whether the SNP is known or not; the presence of known SNPs in variant protein W60282_PEA_1_P14 (SEQ ID NO:1312) sequence provides support for the deduced sequence of this variant protein according to the present invention).

TABLE 332

| | Nucleic acid SNPs | |
|---|---|---|
| SNP position on nucleotide sequence | Alternative nucleic acid | Previously known SNP? |
| 219 | A -> G | Yes |
| 702 | G -> A | Yes |
| 754 | G -> A | Yes |

TABLE 332-continued

| | Nucleic acid SNPs | |
|---|---|---|
| SNP position on nucleotide sequence | Alternative nucleic acid | Previously known SNP? |
| 825 | G -> A | No |
| 1289 | A -> G | Yes |

As noted above, cluster W60282 features 6 segment(s), which were listed in Table 329 above and for which the sequence(s) are given at the end of the application. These segment(s) are portions of nucleic acid sequence(s) which are described herein separately because they are of particular interest. A description of each segment according to the present invention is now provided.

Segment cluster W60282_PEA_1_node_10 (SEQ ID NO:1228) according to the present invention is supported by 45 libraries. The number of libraries was determined as previously described. This segment can be found in the following transcript(s): W60282_PEA_1_T11 (SEQ ID NO:34). Table 333 below describes the starting and ending position of this segment on each transcript.

TABLE 333

| | Segment location on transcripts | |
|---|---|---|
| Transcript name | Segment starting position | Segment ending position |
| W60282_PEA_1_T11 (SEQ ID NO: 34) | 745 | 901 |

Segment cluster W60282_PEA_1_node_18 (SEQ ID NO:1229) according to the present invention is supported by 49 libraries. The number of libraries was determined as previously described. This segment can be found in the following transcript(s): W60282_PEA_1_T11 (SEQ ID NO:34). Table 334 below describes the starting and ending position of this segment on each transcript.

TABLE 334

| | Segment location on transcripts | |
|---|---|---|
| Transcript name | Segment starting position | Segment ending position |
| W60282_PEA_1_T11 (SEQ ID NO: 34) | 902 | 1038 |

Segment cluster W60282_PEA_1_node_22 (SEQ ID NO:1230) according to the present invention is supported by 67 libraries. The number of libraries was determined as previously described. This segment can be found in the following transcript(s): W60282_PEA_1_T11 (SEQ ID NO:34). Table 335 below describes the starting and ending position of this segment on each transcript.

TABLE 335

Segment location on transcripts

| Transcript name | Segment starting position | Segment ending position |
|---|---|---|
| W60282_PEA_1_T11 (SEQ ID NO: 34) | 1072 | 1507 |

Segment cluster W60282_PEA_1_node_5 (SEQ ID NO:1231) according to the present invention is supported by 20 libraries. The number of libraries was determined as previously described. This segment can be found in the following transcript(s): W60282_PEA_1_T11 (SEQ ID NO:34). Table 336 below describes the starting and ending position of this segment on each transcript.

TABLE 336

Segment location on transcripts

| Transcript name | Segment starting position | Segment ending position |
|---|---|---|
| W60282_PEA_1_T11 (SEQ ID NO: 34) | 1 | 669 |

According to an optional embodiment of the present invention, short segments related to the above cluster are also provided. These segments are up to about 120 bp in length, and so are included in a separate description.

Segment cluster W60282_PEA_1_node_21 (SEQ ID NO:1232) according to the present invention is supported by 48 libraries. The number of libraries was determined as previously described. This segment can be found in the following transcript(s): W60282_PEA_1_T11 (SEQ ID NO:34). Table 337 below describes the starting and ending position of this segment on each transcript.

TABLE 337

Segment location on transcripts

| Transcript name | Segment starting position | Segment ending position |
|---|---|---|
| W60282_PEA_1_T11 (SEQ ID NO: 34) | 1039 | 1071 |

Segment cluster W60282_PEA_1_node_8 (SEQ ID NO:1233) according to the present invention is supported by 39 libraries. The number of libraries was determined as previously described. This segment can be found in the following transcript(s): W60282_PEA_1_T11 (SEQ ID NO:34). Table 338 below describes the starting and ending position of this segment on each transcript.

TABLE 338

Segment location on transcripts

| Transcript name | Segment starting position | Segment ending position |
|---|---|---|
| W60282_PEA_1_T11 (SEQ ID NO: 34) | 670 | 744 |

Variant Protein Alignment to the Previously Known Protein:
Sequence name: /tmp/rL7Wdc5hYg/eLOAfKIgqD:KLKB_HUMAN (SEQ ID NO:1428)
Sequence documentation:
Alignment of: W60282_PEA_1_P14 (SEQ ID NO:1312) x KLKB_HUMAN (SEQ ID NO:1428) ..
Alignment segment 1/1:

| Quality: | 645.00 | | |
|---|---|---|---|
| Escore: | 0 | | |
| Matching length: | 72 | Total length: | 72 |
| Matching Percent Similarity: | 94.44 | Matching Percent Identity: | 94.44 |
| Total Percent Similarity: | 94.44 | Total Percent Identity: | 94.44 |
| Gaps: | 0 | | |

Alignment:

```
 1  MRILQLILLALATGLVGGETRIIKGFECKPHSQPWQAALFEKTRLLCGAT  50
    |||||||||||||||||||||||||||||||||||||||||||||||||
 1  MRILQLILLALATGLVGGETRIIKGFECKPHSQPWQAALFEKTRLLCGAT  50

51  LIAPRWLLTAAHCLKPTPASHL                              72
    ||||||||||||||||||  ||
51  LIAPRWLLTAAHCLKPRYIVHL                              72
```

Sequence name: /tmp/rL7Wdc5hYg/eLOAfKIgqD:
Q81XD7 (SEQ ID NO:1705)
Sequence documentation:
Alignment of: W60282_PEA_1_P14 (SEQ ID NO:1312) x
Q81XD7 (SEQ ID NO:1705)..
Alignment segment 1/1:

| | | | |
|---|---|---|---|
| Quality: | 642.00 | | |
| Escore: | 0 | | |
| Matching length: | 66 | Total length: | 66 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MRILQLILLALATGLVGGETRIIKGFECKPHSQPWQAALFEKTRLLCGAT  50
    |||||||||||||||||||||||||||||||||||||||||||||||||
 1  MRILQLILLALATGLVGGETRIIKGFECKPHSQPWQAALFEKTRLLCGAT  50

51  LIAPRWLLTAAHCLKP  66
    ||||||||||||||||
51  LIAPRWLLTAAHCLKP  66
```

Description for Cluster Z41644

Cluster Z41644 features 1 transcript(s) and 21 segment(s) of interest, the names for which are given in Tables 339 and 340, respectively, the sequences themselves are given at the end of the application. The selected protein variants are given in table 341.

TABLE 339

Transcripts of interest

| Transcript Name | Sequence ID No. |
|---|---|
| Z41644_PEA_1_T5 | 35 |

TABLE 340

Segments of interest

| Segment Name | Sequence ID No. |
|---|---|
| Z41644_PEA_1_node_0 | 440 |
| Z41644_PEA_1_node_11 | 441 |
| Z41644_PEA_1_node_12 | 442 |
| Z41644_PEA_1_node_15 | 443 |
| Z41644_PEA_1_node_20 | 444 |
| Z41644_PEA_1_node_24 | 445 |
| Z41644_PEA_1_node_1 | 446 |
| Z41644_PEA_1_node_10 | 447 |
| Z41644_PEA_1_node_13 | 448 |
| Z41644_PEA_1_node_16 | 449 |
| Z41644_PEA_1_node_17 | 450 |
| Z41644_PEA_1_node_19 | 451 |
| Z41644_PEA_1_node_2 | 452 |
| Z41644_PEA_1_node_21 | 453 |
| Z41644_PEA_1_node_22 | 454 |
| Z41644_PEA_1_node_23 | 455 |

TABLE 340-continued

Segments of interest

| Segment Name | Sequence ID No. |
|---|---|
| Z41644_PEA_1_node_25 | 456 |
| Z41644_PEA_1_node_3 | 457 |
| Z41644_PEA_1_node_4 | 458 |
| Z41644_PEA_1_node_6 | 459 |
| Z41644_PEA_1_node_9 | 460 |

TABLE 341

Proteins of interest

| Protein Name | Sequence ID No. |
|---|---|
| Z41644_PEA_1_P10 | 1313 |

These sequences are variants of the known protein Small inducible cytokine B14 precursor (SwissProt accession identifier SZ14_HUMAN; known also according to the synonyms CXCL14; Chemokine BRAK), SEQ ID NO:1429, referred to herein as the previously known protein.

The sequence for protein Small inducible cytokine B14 precursor (SEQ ID NO:1429) is given at the end of the application, as "Small inducible cytokine B 14 precursor amino acid sequence". Protein Small inducible cytokine B14 precursor localization is believed to be Secreted.

The following GO Annotation(s) apply to the previously known protein. The following annotation(s) were found: chemotaxis; signal transduction; cell-cell signaling, which are annotation(s) related to Biological Process; and chemokine, which are annotation(s) related to Molecular Function.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

Cluster Z41644 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 27 refer to weighted expression of ESTs in each category, as "parts per million" (ratio of the expression of ESTs for a particular cluster to the expression of all ESTs in that category, according to parts per million).

Figure 27:
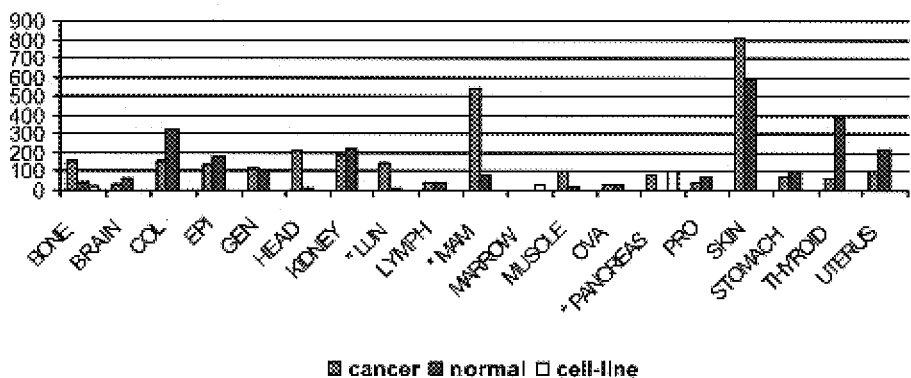
FIG. 27 is a histogram showing Cancer and cell-line vs. normal tissue expression for Cluster Z41644, demonstrating overexpression in lung malignant tumors, breast malignant tumors and pancreas carcinoma.

Overall, the following results were obtained as shown with regard to the histograms in FIG. 27 and Table 342. This cluster is overexpressed (at least at a minimum level) in the following pathological conditions: lung malignant tumors, breast malignant tumors and pancreas carcinoma.

TABLE 342

Normal tissue distribution

| Name of Tissue | Number |
|---|---|
| bone | 45 |
| brain | 62 |
| colon | 327 |
| epithelial | 179 |
| general | 104 |
| head and neck | 10 |
| kidney | 219 |
| lung | 6 |
| lymph nodes | 37 |
| breast | 87 |
| bone marrow | 0 |
| muscle | 20 |
| ovary | 36 |
| pancreas | 0 |
| prostate | 78 |
| skin | 591 |
| stomach | 109 |
| Thyroid | 386 |
| uterus | 218 |

TABLE 343

P values and ratios for expression in cancerous tissue

| Name of Tissue | P1 | P2 | SP1 | R3 | SP2 | R4 |
|---|---|---|---|---|---|---|
| bone | 4.9e−01 | 8.5e−01 | 1.8e−01 | 1.9 | 5.3e−01 | 1.0 |
| brain | 6.7e−01 | 8.0e−01 | 9.1e−01 | 0.6 | 9.9e−01 | 0.4 |
| colon | 6.4e−01 | 7.7e−01 | 9.7e−01 | 0.4 | 1 | 0.3 |
| epithelial | 4.1e−01 | 9.4e−01 | 9.6e−01 | 0.7 | 1 | 0.4 |
| general | 1.5e−01 | 9.4e−01 | 1.8e−01 | 1.0 | 1 | 0.5 |
| head and neck | 1.9e−01 | 3.3e−01 | 4.6e−01 | 2.8 | 7.5e−01 | 1.5 |
| kidney | 7.7e−01 | 8.2e−01 | 7.0e−01 | 0.7 | 9.5e−01 | 0.5 |
| lung | 2.2e−01 | 5.0e−01 | 1.3e−04 | 8.7 | 8.1e−03 | 4.1 |
| lymph nodes | 6.3e−01 | 8.7e−01 | 6.3e−01 | 1.2 | 9.2e−01 | 0.6 |
| breast | 4.0e−01 | 6.5e−01 | 3.9e−04 | 3.5 | 2.9e−02 | 1.9 |
| bone marrow | 1 | 6.7e−01 | 1 | 1.0 | 5.3e−01 | 1.9 |
| muscle | 5.2e−01 | 6.1e−01 | 2.7e−01 | 3.2 | 6.3e−01 | 1.2 |
| ovary | 6.7e−01 | 7.1e−01 | 7.6e−01 | 1.0 | 8.6e−01 | 0.8 |
| pancreas | 2.2e−02 | 2.3e−02 | 5.7e−03 | 7.8 | 1.6e−03 | 8.2 |
| prostate | 8.8e−01 | 9.0e−01 | 8.3e−01 | 0.6 | 9.3e−01 | 0.5 |
| skin | 5.9e−01 | 6.9e−01 | 2.3e−01 | 0.3 | 1 | 0.0 |
| stomach | 6.1e−01 | 8.9e−01 | 8.1e−01 | 0.7 | 9.9e−01 | 0.4 |
| Thyroid | 7.0e−01 | 7.0e−01 | 9.9e−01 | 0.4 | 9.9e−01 | 0.4 |
| uterus | 5.3e−01 | 8.2e−01 | 9.5e−01 | 0.5 | 1 | 0.3 |

As noted above, cluster Z41644 features 1 transcript(s), which were listed in Table 339 above. These transcript(s) encode for protein(s) which are variant(s) of protein Small inducible cytokine B14 precursor (SEQ ID NO:1429). A description of each variant protein according to the present invention is now provided.

Variant protein Z41644_PEA_1_P10 (SEQ ID NO:1313) according to the present invention has an amino acid sequence as given at the end of the application; it is encoded by transcript(s) Z41644_PEA_1_T5 (SEQ ID NO:35). An alignment is given to the known protein (Small inducible cytokine B 14 precursor (SEQ ID NO:1429)) at the end of the application. One or more alignments to one or more previously published protein sequences are given at the end of the application. A brief description of the relationship of the variant protein according to the present invention to each such aligned protein is as follows:

Comparison Report Between Z41644_PEA_1_P10 (SEQ ID NO:1313) and SZ14_HUMAN (SEQ ID NO:1429):

1. An isolated chimeric polypeptide encoding for Z41644_PEA_1_P10 (SEQ ID NO:1313), comprising a first amino acid sequence being at least 90% homologous to MRLLAAALLLLLLALYTARVDGSKCKCS-RKGPKIRYSDVKKLEMKPKYPHCEEKMVII TTKSVS-RYRGQEHCLHPKLQSTKRFIKWYNAWNEKRR corresponding to amino acids 1-95 of SZ14_HUMAN (SEQ ID NO:1429), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLTFLPTRPSCGSQDGKG-PPHQVI (SEQ ID NO:1772) corresponding to amino acids 96-123 of Z41644_PEA_1_P10 (SEQ ID NO:1313), wherein said first and second amino acid sequences are contiguous and in a sequential order.

2. An isolated polypeptide encoding for a tail of Z41644_PEA_1_P10 (SEQ ID NO:1313) comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO:1772) in Z41644_PEA_1_P10 (SEQ ID NO:1313).

Comparison Report Between Z41644_PEA_1_P10 (SEQ ID NO:1313) and Q9NS21 (SEQ ID NO:1706):

1. An isolated chimeric polypeptide encoding for Z41644_PEA_1_P10 (SEQ ID NO:1313), comprising a first amino acid sequence being at least 90% homologous to MRLLAAALLLLLLALYTARVDGSKCKCS-RKGPKIRYSDVKKLEMKPKYPHCEEKMVII TTKSVS-RYRGQEHCLHPKLQSTKRFIKWYNAWNEKRR corresponding to amino acids 13-107 of Q9NS21 (SEQ ID NO:1706), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLTFLPTRPSCGSQDGKG-PPHQVI (SEQ ID NO:1772) corresponding to amino acids 96-123 of Z41644_PEA_1_P10 (SEQ ID NO:1313), wherein said first and second amino acid sequences are contiguous and in a sequential order.

2. An isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO: 1772) in Z41644_PEA_1_P10 (SEQ ID NO:1313).

Comparison Report Between Z41644_PEA_1_P10 (SEQ ID NO:1313) and AAQ89265 (SEQ ID NO:781):

1. An isolated chimeric polypeptide encoding for Z41644_PEA_1_P10 (SEQ ID NO:1313), comprising a first amino acid sequence being at least 90% homologous to MRLLAAALLLLLLALYTARVDGSKCKCS-RKGPKIRYSDVKKLEMKPKYPHCEEKMVII TTKSVS-RYRGQEHCLHPKLQSTKRFIKWYNAWNEKRR corresponding to amino acids 13-107 of AAQ89265 (SEQ ID NO:781), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLTFLPTRPSCGSQDGKG-PPHQVI (SEQ ID NO: 1772) corresponding to amino acids 96-123 of Z41644_PEA_1_P10 (SEQ ID NO:1313), wherein said first and second amino acid sequences are contiguous and in a sequential order.

2. An isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO: 1772) in Z41644_PEA_1_P10 (SEQ ID NO:1313).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z41644_PEA_1_P10 (SEQ ID NO:1313) also has the following non-silent SNPs (Single Nucleotide Polymorphisms) as listed in Table 344, (given according to their position(s) on the amino acid sequence, with the alternative amino acid(s) listed; the last column indicates whether the SNP is known or not; the presence of known SNPs in variant protein Z41644_PEA_1_P10 (SEQ ID NO:1313) sequence provides support for the deduced sequence of this variant protein according to the present invention).

TABLE 344

Amino acid mutations

| SNP position(s) on amino acid sequence | Alternative amino acid(s) | Previously known SNP? |
|---|---|---|
| 32 | P -> H | Yes |
| 64 | s -> | No |
| 80 | T -> A | No |
| 80 | T -> P | No |

Variant protein Z41644_PEA_1_P10 (SEQ ID NO:1313) is encoded by the following transcript(s): Z41644_PEA_1_T5 (SEQ ID NO:35), for which the sequence(s) is/are given at the end of the application. The coding portion of transcript Z41644_PEA_1_T5 (SEQ ID NO:35) is shown in bold; this coding portion starts at position 744 and ends at position 1112. The transcript also has the following SNPs as listed in Table 345 (given according to their position on the nucleotide sequence, with the alternative nucleic acid listed; the last column indicates whether the SNP is known or not; the presence of known SNPs in variant protein Z41644_PEA_1_P10 (SEQ ID NO:1313) sequence provides support for the deduced sequence of this variant protein according to the present invention).

TABLE 345

Nucleic acid SNPs

| SNP position on nucleotide sequence | Alternative nucleic acid | Previously known SNP? |
|---|---|---|
| 102 | A -> G | Yes |
| 572 | C -> | No |
| 3707 | C -> T | Yes |
| 3735 | C -> T | Yes |
| 4079 | G -> A | No |
| 4123 | G -> A | Yes |
| 4233 | A -> G | Yes |
| 4328 | C -> | No |
| 4350 | A -> G | Yes |
| 4376 | G -> A | Yes |
| 4390 | A -> G | Yes |
| 4619 | G -> T | Yes |
| 838 | C -> A | Yes |
| 4754 | C -> T | No |
| 4757 | C -> A | No |
| 4794 | T -> G | No |
| 4827 | G -> | No |
| 934 | C -> | No |
| 981 | A -> C | No |
| 981 | A -> G | No |
| 1817 | A -> C | Yes |
| 2546 | T -> | No |
| 2684 | T -> A | No |
| 2885 | T -> C | Yes |

As noted above, cluster Z41644 features 21 segment(s), which were listed in Table 340 above and for which the sequence(s) are given at the end of the application. These segment(s) are portions of nucleic acid sequence(s) which are described herein separately because they are of particular interest. A description of each segment according to the present invention is now provided.

Segment cluster Z41644_PEA_1_node_0 (SEQ ID NO:1234) according to the present invention is supported by 53 libraries. The number of libraries was determined as previously described. This segment can be found in the following transcript(s): Z41644_PEA_1_T5 (SEQ ID NO:35). Table 346 below describes the starting and ending position of this segment on each transcript.

TABLE 346

Segment location on transcripts

| Transcript name | Segment starting position | Segment ending position |
|---|---|---|
| Z41644_PEA_1_T5 (SEQ ID NO: 35) | 1 | 616 |

Segment cluster Z41644_PEA_1_node_11 (SEQ ID NO:1235) according to the present invention is supported by 9 libraries. The number of libraries was determined as previously described. This segment can be found in the following transcript(s): Z41644_PEA_1_T5 (SEQ ID NO:35). Table 347 below describes the starting and ending position of this segment on each transcript.

TABLE 347

Segment location on transcripts

| Transcript name | Segment starting position | Segment ending position |
|---|---|---|
| Z41644_PEA_1_T5 (SEQ ID NO:35) | 1028 | 2089 |

Segment cluster Z41644_PEA_1_node_12 (SEQ ID NO:1236) according to the present invention is supported by 6 libraries. The number of libraries was determined as previously described. This segment can be found in the following transcript(s): Z41644_PEA_1_T5 (SEQ ID NO:35). Table 348 below describes the starting and ending position of this segment on each transcript.

TABLE 347

Segment location on transcripts

| Transcript name | Segment starting position | Segment ending position |
|---|---|---|
| Z41644_PEA_1_T5 (SEQ ID NO: 35) | 1028 | 2089 |

Segment cluster Z41644_PEA_1_node_15 (SEQ ID NO:1237) according to the present invention is supported by 23 libraries. The number of libraries was determined as previously described. This segment can be found in the following transcript(s): Z41644_PEA_1_T5 (SEQ ID NO:35). Table 349 below describes the starting and ending position of this segment on each transcript.

TABLE 349

Segment location on transcripts

| Transcript name | Segment starting position | segment ending position |
|---|---|---|
| Z41644_PEA_1_T5 (SEQ ID NO: 35) | 2368 | 3728 |

Segment cluster Z41644_PEA_1_node_20 (SEQ ID NO:1238) according to the present invention is supported by 260 libraries. The number of libraries was determined as previously described. This segment can be found in the following transcript(s): Z41644_PEA_1_T5 (SEQ ID NO:35). Table 350 below describes the starting and ending position of this segment on each transcript.

TABLE 350

Segment location on transcripts

| Transcript name | Segment starting position | Segment ending position |
|---|---|---|
| Z41644_PEA_1_T5 (SEQ ID NO: 35) | 3938 | 4506 |

Segment cluster Z41644_PEA_1_node_24 (SEQ ID NO:1239) according to the present, invention is supported by 185 libraries. The number of libraries was determined as previously described. This segment can be found in the following transcript(s): Z41644_PEA_1_T5 (SEQ ID NO:35). Table 351 below describes the starting and ending position of this segment on each transcript.

TABLE 351

Segment location on transcripts

| Transcript name | Segment starting position | Segment ending position |
|---|---|---|
| Z41644_PEA_1_T5 (SEQ ID NO: 35) | 4637 | 4799 |

According to an optional embodiment of the present invention, short segments related to the above cluster are also provided. These segments are up to about 120 bp in length, and so are included in a separate description.

Segment cluster Z41644_PEA_1_node_1 (SEQ ID NO:1240) according to the present invention is supported by 53 libraries. The number of libraries was determined as previously described. This segment can be found in the following transcript(s): Z41644_PEA_1_T5 (SEQ ID NO:35). Table 352 below describes the starting and ending position of this segment on each transcript.

TABLE 352

Segment location on transcripts

| Transcript name | Segment starting position | Segment ending position |
|---|---|---|
| Z41644_PEA_1_T5 (SEQ ID NO: 35) | 617 | 697 |

Segment cluster Z41644_PEA_1_node_10 (SEQ ID NO:1241) according to the present invention is supported by 138 libraries. The number of libraries was determined as previously described. This segment can be found in the following transcript(s): Z41644_PEA_1_T5 (SEQ ID NO:35). Table 353 below describes the starting and ending position of this segment on each transcript.

TABLE 353

Segment location on transcripts

| Transcript name | Segment starting position | Segment ending position |
|---|---|---|
| Z41644_PEA_1_T5 (SEQ ID NO: 35) | 972 | 1027 |

Segment cluster Z41644_PEA_1_node_13 (SEQ ID NO:1242) according to the present invention can be found in the following transcript(s): Z41644_PEA_1_T5 (SEQ ID NO:35). Table 354 below describes the starting and ending position of this segment on each transcript.

TABLE 354

Segment location on transcripts

| Transcript name | Segment starting position | Segment ending position |
|---|---|---|
| Z41644_PEA_1_T5 (SEQ ID NO: 35) | 2351 | 2367 |

Segment cluster Z41644_PEA_1_node_16 (SEQ ID NO:1243) according to the present invention is supported by 152 libraries. The number of libraries was determined as previously described. This segment can be found in the following transcript(s): Z41644_PEA_1_T5 (SEQ ID NO:35). Table 355 below describes the starting and ending position of this segment on each transcript.

TABLE 355

| | Segment location on transcripts | |
|---|---|---|
| Transcript name | Segment starting position | Segment ending position |
| Z41644_PEA_1_T5 (SEQ ID NO: 35) | 3729 | 3809 |

Segment cluster Z41644_PEA_1_node_17 (SEQ ID NO:1244) according to the present invention can be found in the following transcript(s): Z41644_PEA_1_T5 (SEQ ID NO:35). Table 356 below describes the starting and ending position of this segment on each transcript.

TABLE 356

| | Segment location on transcripts | |
|---|---|---|
| Transcript name | Segment starting position | Segment ending position |
| Z41644_PEA_1_T5 (SEQ ID NO: 35) | 3810 | 3829 |

Segment cluster Z41644_PEA_1_node_19 (SEQ ID NO:1245) according to the present invention is supported by 112 libraries. The number of libraries was determined as previously described. This segment can be found in the following transcript(s): Z41644_PEA_1_T5 (SEQ ID NO:35). Table 357 below describes the starting and ending position of this segment on each transcript.

TABLE 357

| | Segment location on transcripts | |
|---|---|---|
| Transcript name | Segment starting position | Segment ending position |
| Z41644_PEA_1_T5 (SEQ ID NO: 35) | 3830 | 3937 |

Segment cluster Z41644_PEA_1_node_2 (SEQ ID NO:1246) according to the present invention is supported by 58 libraries. The number of libraries was determined as previously described. This segment can be found in the following transcript(s): Z41644_PEA_1_T5 (SEQ ID NO:35). Table 358 below describes the starting and ending position of this segment on each transcript.

TABLE 358

| | Segment location on transcripts | |
|---|---|---|
| Transcript name | Segment starting position | Segment ending position |
| Z41644_PEA_1_T5 (SEQ ID NO: 35) | 698 | 737 |

Segment cluster Z41644_PEA_1_node_21 (SEQ ID NO:1247) according to the present invention can be found in the following transcript(s): Z41644_PEA_1_T5 (SEQ ID NO:35). Table 359 below describes the starting and ending position of this segment on each transcript.

TABLE 359

| | Segment location on transcripts | |
|---|---|---|
| Transcript name | Segment starting position | Segment ending position |
| Z41644_PEA_1_T5 (SEQ ID NO: 35) | 4507 | 4529 |

Segment cluster Z41644_PEA_1_node_22 (SEQ ID NO:1248) according to the present invention is supported by 164 libraries. The number of libraries was determined as previously described. This segment can be found in the following transcript(s): Z41644_PEA_1_T5 (SEQ ID NO:35). Table 360 below describes the starting and ending position of this segment on each transcript.

TABLE 360

| | Segment location on transcripts | |
|---|---|---|
| Transcript name | Segment starting position | Segment ending position |
| Z41644_PEA_1_T5 (SEQ ID NO: 35) | 4530 | 4582 |

Segment cluster Z41644_PEA_1_node_23 (SEQ ID NO:1249) according to the present invention is supported by 169 libraries. The number of libraries was determined as previously described. This segment can be found in the following transcript(s): Z41644_PEA_1_T5 (SEQ ID NO:35). Table 361 below describes the starting and ending position of this segment on each transcript.

TABLE 361

| | Segment location on transcripts | |
|---|---|---|
| Transcript name | Segment starting position | Segment ending position |
| Z41644_PEA_1_T5 (SEQ ID NO: 35) | 4583 | 4636 |

Segment cluster Z41644_PEA_1_node_25 (SEQ ID NO:1250) according to the present invention is supported by 138 libraries. The number of libraries was determined as previously described. This segment can be found in the following transcript(s): Z41644_PEA_1_T5 (SEQ ID NO:35). Table 362 below describes the starting and ending position of this segment on each transcript.

TABLE 362

| | Segment location on transcripts | |
|---|---|---|
| Transcript name | Segment starting position | Segment ending position |
| Z41644_PEA_1_T5 (SEQ ID NO: 35) | 4800 | 4902 |

Segment cluster Z41644_PEA_1_node_3 (SEQ ID NO:1251) according to the present invention is supported by 75 libraries. The number of libraries was determined as previously described. This segment can be found in the following transcript(s): Z41644_PEA_1_T5 (SEQ ID NO:35). Table 363 below describes the starting and ending position of this segment on each transcript.

TABLE 363

Segment location on transcripts

| Transcript name | Segment starting position | Segment ending position |
|---|---|---|
| Z41644_PEA_1_T5 (SEQ ID NO: 35) | 738 | 773 |

Segment cluster Z41644_PEA_1_node_4 (SEQ ID NO:1252) according to the present invention is supported by 61 libraries. The number of libraries was determined as previously described. This segment can be found in the following transcript(s): Z41644_PEA_1_T5 (SEQ ID NO:35). Table 364 below describes the starting and ending position of this segment on each transcript.

TABLE 364

Segment location on transcripts

| Transcript name | Segment starting position | Segment ending position |
|---|---|---|
| Z41644_PEA_1_T5 (SEQ ID NO: 35) | 774 | 807 |

Segment cluster Z41644_PEA_1_node_6 (SEQ ID NO:1253) according to the present invention is supported by 101 libraries. The number of libraries was determined as previously described. This segment can be found in the following transcript(s): Z41644_PEA_1_T5 (SEQ ID NO:35). Table 365 below describes the starting and ending position of this segment on each transcript.

TABLE 365

Segment location on transcripts

| Transcript name | Segment starting position | Segment ending position |
|---|---|---|
| Z41644_PEA_1_T5 (SEQ ID NO: 35) | 808 | 913 |

Segment cluster Z41644_PEA_1_node_9 (SEQ ID NO:1254) according to the present invention is supported by 134 libraries. The number of libraries was determined as previously described. This segment can be found in the following transcript(s): Z41644_PEA_1_T5 (SEQ ID NO:35). Table 366 below describes the starting and ending position of this segment on each transcript.

TABLE 366

Segment location on transcripts

| Transcript name | Segment starting position | Segment ending position |
|---|---|---|
| Z41644_PEA_1_T5 (SEQ ID NO: 35) | 914 | 971 |

Variant Protein Alignment to the Previously Known Protein:

Sequence name: /tmp/p5SSvhT9Xp/HQeIMsUrfm:SZ14_HUMAN (SEQ ID NO:1429)

Sequence documentation:

Alignment of: Z41644_PEA_1_P10 (SEQ ID NO:1313) x SZ14_HUMAN (SEQ ID NO:1429) ..

Alignment segment 1/1:

| Quality: | 953.00 | | |
|---|---|---|---|
| Escore: | 0 | | |
| Matching length: | 95 | Total length: | 95 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MRLLAAALLLLLLALYTARVDGSKCKCSRKGPKIRYSDVKKLEMKPKYPH   50
     ||||||||||||||||||||||||||||||||||||||||||||||||||
  1  MRLLAAALLLLLLALYTARVDGSKCKCSRKGPKIRYSDVKKLEMKPKYPH   50

51  CEEKMVIITTKSVSRYRGQEHCLHPKLQSTKRFIKWYNAWNEKRR        95
     |||||||||||||||||||||||||||||||||||||||||||||
 51  CEEKMVIITTKSVSRYRGQEHCLHPKLQSTKRFIKWYNAWNEKRR        95
```

Sequence name: /tmp/p5SSvhT9Xp/HQeIMsUrfm:Q9NS21 (SEQ ID NO:1706)

Sequence documentation:

Alignment of: Z41644_PEA_1_P10 (SEQ ID NO:1313) x Q9NS21 (SEQ ID NO:1706) ..

Alignment segment 1/1:

| Quality: | 957.00 | | |
|---|---|---|---|
| Escore: | 0 | | |
| Matching length: | 96 | Total length: | 96 |
| Matching Percent Similarity: | 100.00 | Matching Percent Identity: | 98.96 |
| Total Percent Similarity: | 100.00 | Total Percent Identity: | 98.96 |
| Gaps: | 0 | | |

Alignment:

```
 1  MRLLAAALLLLLLALYTARVDGSKCKCSRKGPKIRYSDVKKLEMKPKYPH   50
    ||||||||||||||||||||||||||||||||||||||||||||||||||
13  MRLLAAALLLLLLALYTARVDGSKCKCSRKGPKIRYSDVKKLEMKPKYPH   62

51  CEEKMVIITTKSVSRYRGQEHCLHPKLQSTKRFIKWYNAWNEKRRY       96
    |||||||||||||||||||||||||||||||||||||||||||:
63  CEEKMVIITTKSVSRYRGQEHCLHPKLQSTKRFIKWYNAWNEKRRF       108
```

Sequence name: /tmp/p5SSvhT9Xp/HQeIMsUrfm: AAQ89265 (SEQ ID NO:781)
Sequence documentation:
Alignment of: Z41644_PEA_1_P10 (SEQ ID NO:1313) x AAQ89265 (SEQ ID NO:781) ..
Alignment segment 1/1:

| | | | |
|---|---|---|---|
| Quality: | 953.00 | | |
| Escore: | 0 | | |
| Matching length: | 95 | Total length: | 95 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MRLLAAALLLLLLALYTARVDGSKCKCSRKGPKIRYSDVKKLEMKPKYPH   50
    ||||||||||||||||||||||||||||||||||||||||||||||||||
13  MRLLAAALLLLLLALYTARVDGSKCKCSRKGPKIRYSDVKKLEMKPKYPH   62

51  CEEKMVIITTKSVSRYRGQEHCLHPKLQSTKRFIKWYNAWNEKRR        95
    ||||||||||||||||||||||||||||||||||||||||||||
63  CEEKMVIITTKSVSRYRGQEHCLHPKLQSTKRFIKWYNAWNEKRR        107
```

Description for Cluster Z44808

Cluster Z44808 features 5 transcript(s) and 21 segment(s) of interest, the names for which are given in Tables 367 and 368, respectively, the sequences themselves are given at the end of the application. The selected protein variants are given in table 369.

TABLE 367

Transcripts of interest

| Transcript Name | Sequence ID No. |
|---|---|
| Z44808_PEA_1_T11 | 36 |
| Z44808_PEA_1_T4 | 37 |
| Z44808_PEA_1_T5 | 38 |
| Z44808_PEA_1_T8 | 39 |
| Z44808_PEA_1_T9 | 40 |

TABLE 368

Segments of interest

| Segment Name | Sequence ID No. |
|---|---|
| Z44808_PEA_1_node_0 | 461 |
| Z44808_PEA_1_node_16 | 462 |
| Z44808_PEA_1_node_2 | 463 |

TABLE 368-continued

Segments of interest

| Segment Name | Sequence ID No. |
|---|---|
| Z44808_PEA_1_node_24 | 464 |
| Z44808_PEA_1_node_32 | 465 |
| Z44808_PEA_1_node_33 | 466 |
| Z44808_PEA_1_node_36 | 467 |
| Z44808_PEA_1_node_37 | 468 |
| Z44808_PEA_1_node_41 | 469 |
| Z44808_PEA_1_node_11 | 470 |
| Z44808_PEA_1_node_13 | 471 |
| Z44808_PEA_1_node_18 | 472 |
| Z44808_PEA_1_node_22 | 473 |
| Z44808_PEA_1_node_26 | 474 |
| Z44808_PEA_1_node_30 | 475 |

TABLE 368-continued

Segments of interest

| Segment Name | Sequence ID No. |
|---|---|
| Z44808_PEA_1_node_34 | 476 |
| Z44808_PEA_1_node_35 | 477 |
| Z44808_PEA_1_node_39 | 478 |
| Z44808_PEA_1_node_4 | 479 |
| Z44808_PEA_1_node_6 | 480 |
| Z44808_PEA_1_node_8 | 481 |

TABLE 369

Proteins of interest

| Protein Name | Sequence ID No. |
|---|---|
| Z44808_PEA_1_P5 | 1314 |
| Z44808_PEA_1_P6 | 1315 |
| Z44808_PEA_1_P7 | 1316 |
| Z44808_PEA_1_P11 | 1317 |

These sequences are variants of the known protein SPARC related modular calcium-binding protein 2 precursor (SwissProt accession identifier SMO2_HUMAN; known also according to the synonyms Secreted modular calcium-binding protein 2; SMOC-2; Smooth muscle-associated protein 2;

SMAP-2; MSTP117), SEQ ID NO: 1430, referred to herein as the previously known protein.

Protein SPARC related modular calcium-binding protein 2 precursor (SEQ ID NO:1430) is known or believed to have the following function(s): calcium binding. The sequence for protein SPARC related modular calcium-binding protein 2 precursor is given at the end of the application, as "SPARC related modular calcium-binding protein 2 precursor amino acid sequence". Known polymorphisms for this sequence are as shown in Table 370.

TABLE 370

Amino acid mutations for Known Protein

| SNP position(s) on amino acid sequence | Comment |
|---|---|
| 169-170 | KT -> TR |
| 212 | S -> P |
| 429-446 | TPRGHAESTSNRQPRKQG -> RSKRNL |
| 434 | A -> V |
| 439 | N -> Y |

Protein SPARC related modular calcium-binding protein 2 precursor (SEQ ID NO:1430) localization is believed to be Secreted.

Cluster Z44808 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 28 refer to weighted expression of ESTs in each category, as "parts per million" (ratio of the expression of ESTs for a particular cluster to the expression of all ESTs in that category, according to parts per million).

Figure 28:
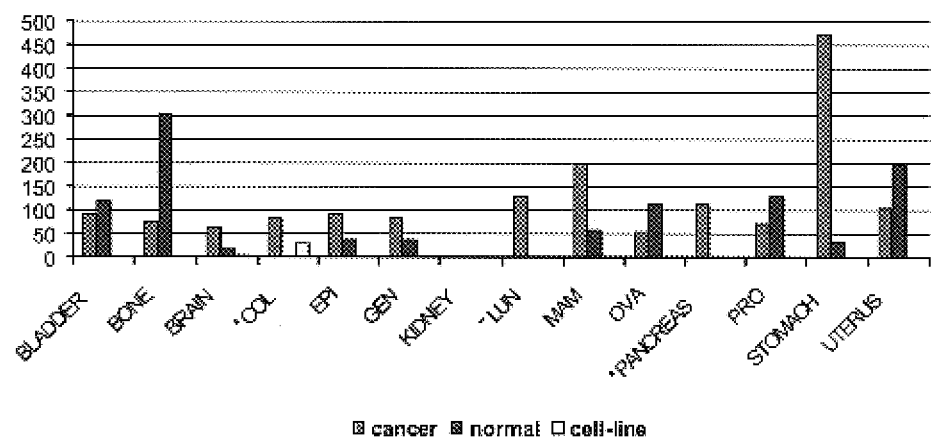
FIG. 28 is a histogram showing Cancer and cell-line vs. normal tissue expression for Cluster Z44808, demonstrating overexpression in colorectal cancer, lung cancer and pancreas carcinoma.

Overall, the following results were obtained as shown with regard to the histograms in FIG. 28 and Table 371. This cluster is overexpressed (at least at a minimum level) in the following pathological conditions: colorectal cancer, lung cancer and pancreas carcinoma.

TABLE 371

Normal tissue distribution

| Name of Tissue | Number |
|---|---|
| bladder | 123 |
| bone | 304 |
| brain | 18 |
| colon | 0 |
| epithelial | 40 |
| general | 37 |
| kidney | 2 |
| lung | 0 |
| breast | 61 |
| ovary | 116 |
| pancreas | 0 |
| prostate | 128 |
| stomach | 36 |
| uterus | 195 |

TABLE 372

P values and ratios for expression in cancerous tissue

| Name of Tissue | P1 | P2 | SP1 | R3 | SP2 | R4 |
|---|---|---|---|---|---|---|
| bladder | 6.8e−01 | 7.6e−01 | 7.7e−01 | 0.8 | 9.1e−01 | 0.6 |
| bone | 7.0e−01 | 8.8e−01 | 9.9e−01 | 0.3 | 1 | 0.2 |

TABLE 372-continued

P values and ratios for expression in cancerous tissue

| Name of Tissue | P1 | P2 | SP1 | R3 | SP2 | R4 |
|---|---|---|---|---|---|---|
| brain | 6.8e−01 | 7.2e−01 | 3.0e−02 | 2.6 | 1.7e−01 | 1.6 |
| colon | 9.2e−03 | 1.3e−02 | 1.2e−01 | 3.6 | 1.6e−01 | 3.1 |
| epithelial | 2.1e−02 | 4.0e−01 | 1.0e−04 | 1.9 | 2.7e−01 | 1.0 |
| general | 2.6e−02 | 7.2e−01 | 4.9e−07 | 1.9 | 3.0e−01 | 1.0 |
| kidney | 7.3e−01 | 8.1e−01 | 1 | 1.0 | 1 | 1.0 |
| lung | 4.0e−03 | 1.8e−02 | 8.0e−04 | 12.2 | 2.1e−02 | 6.0 |
| breast | 4.8e−01 | 6.1e−01 | 9.8e−02 | 2.0 | 3.9e−01 | 1.2 |
| ovary | 8.1e−01 | 8.3e−01 | 9.1e−01 | 0.6 | 9.7e−01 | 0.5 |
| pancreas | 1.2e−01 | 2.1e−01 | 1.0e−03 | 6.5 | 5.9e−03 | 4.6 |
| prostate | 8.4e−01 | 8.9e−01 | 9.0e−01 | 0.6 | 9.8e−01 | 0.4 |
| stomach | 5.0e−01 | 8.7e−01 | 9.6e−04 | 1.5 | 1.9e−01 | 0.8 |
| uterus | 6.7e−01 | 7.9e−01 | 9.2e−01 | 0.5 | 1 | 0.3 |

As noted above, cluster Z44808 features 5 transcript(s), which were listed in Table 367 above. These transcript(s) encode for protein(s) which are variant(s) of protein SPARC related modular calcium-binding protein 2 precursor (SEQ ID NO:1430). A description of each variant protein according to the present invention is now provided.

Variant protein Z44808_PEA_1_P5 (SEQ ID NO:1314) according to the present invention has an amino acid sequence as given at the end of the application; it is encoded by transcript(s) Z44808_PEA_1_T4 (SEQ ID NO:37). An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison Report Between Z44808_PEA_1_P5 (SEQ ID NO:1314) and SMO2_HUMAN (SEQ ID NO:1430):

1. An isolated chimeric polypeptide encoding for Z44808_PEA_1_P5 (SEQ ID NO:1314), comprising a first amino acid sequence being at least 90% homologous to MLL-PQLCWLPLLAGLLPPVPAQKFSALTFL-RVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKTDDAA APALETQPQGDEEDIASRYPTLWTEQVK-SRQNKTNKNSVSSCDQEHQSALEEAKQPKN DNVVI-PECAHGGLYKPVQCHPSTGYCWCVLVDT-GRPIPGTSTRYEQPKCDNTARAHPA KARDLYKGRQLQGCPGAKKHEFLTSV-LDALSTDMVHAASDPSSSSGRLSEPDPSHTLEE RVVHWYFKLLDKNSSGDIGKKEIK-PFKRFLRKKSKPKKCVKKFVEYCDVNNDKSISVQ ELMGCLGVAKEDGKADTKKRHTPRGHAESTSNRQ corresponding to amino acids 1-441 of SMO2_HUMAN (SEQ ID NO:1430), which also corresponds to amino acids 1-441 of Z44808_PEA_1_P5 (SEQ ID NO:1314), and a second amino acid sequence being at least 70%, optionally at least 80%, preferably at least 85%, more preferably at least 90% and most preferably at least 95% homologous to a polypeptide having the sequence DAMVVSSRPKATTHRK-SRTLSRR (SEQ ID NO:1751) corresponding to amino acids 442-464 of Z44808_PEA_1_P5 (SEQ ID NO:1314), wherein said first and second amino acid sequences are contiguous and in a sequential order.

2. An isolated polypeptide encoding for a tail of Z44808_PEA_1_P5 (SEQ ID NO:1314), comprising a polypeptide being at least 70%, optionally at least about 80%, preferably at least about 85%, more preferably at least about 90% and most preferably at least about 95% homologous to the sequence DAMVVSSRPKATTHRKSRTLSRR (SEQ ID NO:1751) in Z44808_PEA_1_P5 (SEQ ID NO:1314).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P5 (SEQ ID NO:1314) is encoded by the following transcript(s): Z44808_PEA_1_T4 (SEQ ID NO:37), for which the sequence(s) is/are given at the end of the application. The coding portion of transcript Z44808_PEA_1_T4 (SEQ ID NO:37) is shown in bold; this coding portion starts at position 586 and ends at position 1977. The transcript also has the following SNPs as listed in Table 373 (given according to their position on the nucleotide sequence, with the alternative nucleic acid listed; the last column indicates whether the SNP is known or not; the presence of known SNPs in variant protein Z44808_PEA_1_P5 (SEQ ID NO:1314) sequence provides support for the deduced sequence of this variant protein according to the present invention).

TABLE 373

Nucleic acid SNPs

| SNP position on nucleotide sequence | Alternative nucleic acid | Previously known SNP? |
|---|---|---|
| 549 | A -> G | No |
| 648 | T -> G | No |
| 4403 | G -> T | No |
| 4456 | G -> A | Yes |
| 4964 | G -> C | Yes |
| 1025 | C -> | No |
| 1677 | T -> C | No |
| 2691 | C -> T | Yes |
| 3900 | T -> C | No |
| 3929 | G -> A | Yes |
| 4099 | G -> T | Yes |
| 4281 | T -> C | No |
| 4319 | G -> C | Yes |

Variant protein Z44808_PEA_1_P6 (SEQ ID NO:1315) according to the present invention has an amino acid sequence as given at the end of the application; it is encoded by transcript(s) Z44808_PEA_1_T5 (SEQ ID NO:38). An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison Report Between Z44808_PEA_1_P6 (SEQ ID NO:1315) and SMO2_HUMAN (SEQ ID NO:1430):

1. An isolated chimeric polypeptide encoding for Z44808_PEA_1_P6 (SEQ ID NO:1315), comprising a first amino acid sequence being at least 90% homologous to MLL-PQLCWLPLLAGLLPPVPAQKFSALTFL-
RVDQDKDKDCSLDCAGSPQKPLCASDGR
TFLSRCEFQRAKCKDPQLEIAYRGNCKD-
VSRCVAERKYTQEQARKEFQQVFIPECNDD
GTYSQVQCHSYTGYCWCVTPNGRPISG-
TAVAHKTPRCPGSVNEKLPQREGTGKTDDAA
APALETQPQGDEEDIASRYPTLWTEQVK-
SRQNKTNKNSVSSCDQEHQSALEEAKQPKN DNVVI-
PECAHGGLYKPVQCHPSTGYCWCVLVDT-
GRPIPGTSTRYEQPKCDNTARAHPA
KARDLYKGRQLQGCPGAKKHEFLTSV-
LDALSTDMVHAASDPSSSSGRLSEPDPSHTLEE
RVVHWYFKLLDKNSSGDIGKKEIK-
PFKRFLRKKSKPKKCVKKFVEYCDVNNDKSISVQ
ELMGCLGVAKEDGKADTKKRH corresponding to amino acids 1-428 of SMO2_HUMAN (SEQ ID NO:1430), which also corresponds to amino acids 1-428 of Z44808_PEA_1_P6 (SEQ ID NO:1315), and a second amino acid sequence being at least 70%, optionally at least 80%, preferably at least 85%, more preferably at least 90% and most preferably at least 95% homologous to a polypeptide having the sequence RSKRNL (SEQ ID NO:1752) corresponding to amino acids 429-434 of Z44808_PEA_1_P6 (SEQ ID NO:1315), wherein said first and second amino acid sequences are contiguous and in a sequential order.

2. An isolated polypeptide encoding for a tail of Z44808_PEA_1_P6 (SEQ ID NO:1315), comprising a polypeptide being at least 70%, optionally at least about 80%, preferably at least about 85%, more preferably at least about 90% and most preferably at least about 95% homologous to the sequence RSKRNL (SEQ ID NO: 1752) in Z44808_PEA_1_P6 (SEQ ID NO:1315).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P6 (SEQ ID NO:1315) also has the following non-silent SNPs (Single Nucleotide Polymorphisms) as listed in Table 374, (given according to their position(s) on the amino acid sequence, with the alternative amino acid(s) listed; the last column indicates whether the SNP is known or not; the presence of known SNPs in variant protein Z44808_PEA_1_P6 (SEQ ID NO:1315) sequence provides support for the deduced sequence of this variant protein according to the present invention).

TABLE 374

Amino acid mutations

| SNP position(s) on amino acid sequence | Alternative amino acid(s) | Previously known SNP? |
|---|---|---|
| 147 | A -> | No |

Variant protein Z44808_PEA_1_P6 (SEQ ID NO:1315) is encoded by the following transcript(s): Z44808_PEA_1_T5 (SEQ ID NO:38), for which the sequence(s) is/are given at the end of the application. The coding portion of transcript Z44808_PEA_1_T5 (SEQ ID NO:38) is shown in bold; this coding portion starts at position 586 and ends at position 1887. The transcript also has the following SNPs as listed in Table 375 (given according to their position on the nucleotide sequence, with the alternative nucleic acid listed; the last column indicates whether the SNP is known or not; the presence of known SNPs in variant protein Z44808_PEA_1_P6 (SEQ ID NO:1315) sequence provides support for the deduced sequence of this variant protein according to the present invention).

TABLE 375

Nucleic acid SNPs

| SNP position on nucleotide sequence | Alternative nucleic acid | Previously known SNP? |
|---|---|---|
| 549 | A -> G | No |
| 648 | T -> G | No |
| 2866 | G -> A | Yes |
| 3374 | G -> C | Yes |
| 1025 | C -> | No |
| 1677 | T -> C | No |
| 2310 | T -> C | No |
| 2339 | G -> A | Yes |
| 2509 | G -> T | Yes |
| 2691 | T -> C | No |
| 2729 | G -> C | Yes |
| 2813 | G -> T | No |

Variant protein Z44808_PEA_1_P7 (SEQ ID NO:1316) according to the present invention has an amino acid sequence as given at the end of the application; it is encoded by transcript(s) Z44808_PEA_1_T9 (SEQ ID NO:40). An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison Report Between Z44808_PEA_1_P7 (SEQ ID NO:1316) and SMO2_HUMAN (SEQ ID NO:1430):

1. An isolated chimeric polypeptide encoding for Z44808_PEA_1_P7 (SEQ ID NO:1316), comprising a first amino acid sequence being at least 90% homologous to MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKN DNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQ corresponding to amino acids 1-441 of SMO2_HUMAN (SEQ ID NO:1430), which also corresponds to amino acids 1-441 of Z44808_PEA_1_P7 (SEQ ID NO:1316), and a second amino acid sequence being at least 70%, optionally at least 80%, preferably at least 85%, more preferably at least 90% and most preferably at least 95% homologous to a polypeptide having the sequence LLWLRGKVSFYCF (SEQ ID NO:1753) corresponding to amino acids 442-454 of Z44808_PEA_1_P7 (SEQ ID NO:1316), wherein said first and second amino acid sequences are contiguous and in a sequential order.

2. An isolated polypeptide encoding for a tail of Z44808_PEA_1_P7 (SEQ ID NO:1316), comprising a polypeptide being at least 70%, optionally at least about 80%, preferably at least about 85%, more preferably at least about 90% and most preferably at least about 95% homologous to the sequence LLWLRGKVSFYCF (SEQ ID NO:1753) in Z44808_PEA_1_P7 (SEQ ID NO:1316).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P7 (SEQ ID NO:1316) also has the following non-silent SNPs (Single Nucleotide Polymorphisms) as listed in Table 376, (given according to their position(s) on the amino acid sequence, with the alternative amino acid(s) listed; the last column indicates whether the SNP is known or not; the presence of known SNPs in variant protein Z44808_PEA_1_P7 (SEQ ID NO:1316) sequence provides support for the deduced sequence of this variant protein according to the present invention).

TABLE 376

Amino acid mutations

| SNP position(s) on amino acid sequence | Alternative amino acid(s) | Previously known SNP? |
|---|---|---|
| 147 | A -> | No |

Variant protein Z44808_PEA_1_P7 (SEQ ID NO:1316) is encoded by the following transcript(s): Z44808_PEA_1_T9 (SEQ ID NO:40), for which the sequence(s) is/are given at the end of the application. The coding portion of transcript Z44808_PEA_1_T9 (SEQ ID NO:40) is shown in bold; this coding portion starts at position 586 and ends at position 1947. The transcript also has the following SNPs as listed in Table 377 (given according to their position on the nucleotide sequence, with the alternative nucleic acid listed; the last column indicates whether the SNP is known or not; the presence of known SNPs in variant protein Z44808_PEA_1_P7 (SEQ ID NO:1316) sequence provides support for the deduced sequence of this variant protein according to the present invention).

TABLE 377

Nucleic acid SNPs

| SNP position on nucleotide sequence | Alternative nucleic acid | Previously known SNP? |
|---|---|---|
| 549 | A -> G | No |
| 648 | T -> G | No |
| 1025 | C -> | No |
| 1677 | T -> C | No |
| 2169 | C -> A | Yes |

Variant protein Z44808_PEA_1_P11 (SEQ ID NO:1317) according to the present invention has an amino acid sequence as given at the end of the application; it is encoded by transcript(s) Z44808_PEA_1_T11 (SEQ ID NO:36). The identification of this transcript was performed using a non-EST based method for identification of alternative splicing, described in the following reference: "Sorek R et al., Genome Res. (2004) 14:1617-23." An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison Report Between Z44808_PEA_1_P11 (SEQ ID NO:1317) and SMO2_HUMAN (SEQ ID NO:1430):

1. An isolated chimeric polypeptide encoding for Z44808_PEA_1_P11 (SEQ ID NO:1317), comprising a first amino acid sequence being at least 90% homologous to MLLPQLCWLPLLAGLLPPVPAQKFSALTFL-RVDQDKDKDCSLDCAGSPQKPLCASDGR TFLSRCEFQRAKCKDPQLEIAYRGNCKD-VSRCVAERKYTQEQARKEFQQVFIPECNDD GTYSQVQCHSYTGYCWCVTPNGRPISG-TAVAHKTPRCPGSVNEKLPQREGTGKT corresponding to amino acids 1-170 of SMO2_HUMAN (SEQ ID NO:1430), which also corresponds to amino acids 1-170 of Z44808_PEA_1_P11 (SEQ ID NO:1317), and a second amino acid sequence being at least 90% homologous to DIASRYPTLWTEQVKSRQNKTNKNSVSS-CDQEHQSALEEAKQPKNDNVVIPECAHGGL YKPVQCHPSTGYCWCVLVDT-GRPIPGTSTRYEQPKCDNTARAHPA-KARDLYKGRQLQ GCPGAKKHEFLTSVLDALSTDM-VHAASDPSSSSGRLSEPDPSHTLEERVVHWYFKLLD KNSSGDIGKKEIKPFKRFLRKKSKP-KKCVKKFVEYCDVNNDKSISVQELMGCLGVAKE DGKADTKKRHTPRGHAESTSNRQPRKQG corresponding to amino acids 188-446 of SMO2_HUMAN (SEQ ID NO:1430), which also corresponds to amino acids 171-429 of Z44808_PEA_1_P11 (SEQ ID NO:1317), wherein said first and second amino acid sequences are contiguous and in a sequential order.

2. An isolated chimeric polypeptide encoding for an edge portion of Z44808_PEA_1_P11 (SEQ ID NO:1317), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 170−x to −170; and ending at any of amino acid numbers 171+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P11 (SEQ ID NO:1317) also has the following non-silent SNPs (Single Nucleotide Polymorphisms) as listed in Table 378, (given according to their position(s) on the amino acid sequence, with the alternative amino acid(s) listed; the last column indicates whether the SNP is known or not; the presence of known SNPs in variant protein Z44808_PEA_1_P11 (SEQ ID NO:1317) sequence provides support for the deduced sequence of this variant protein according to the present invention).

TABLE 378

| Amino acid mutations | | |
|---|---|---|
| SNP position(s) on amino acid sequence | Alternative amino acid(s) | Previously known SNP? |
| 147 | A -> | No |

Variant protein Z44808_PEA_1_P11 (SEQ ID NO:1317) is encoded by the following transcript(s): Z44808_PEA_1_T11 (SEQ ID NO:36), for which the sequence(s) is/are given at the end of the application. The coding portion of transcript Z44808_PEA_1_T11 (SEQ ID NO:36) is shown in bold; this coding portion starts at position 586 and ends at position 1872. The transcript also has the following SNPs as listed in Table 379 (given according to their position on the nucleotide sequence, with the alternative nucleic acid listed; the last column indicates whether the SNP is known or not; the presence of known SNPs in variant protein Z44808_PEA_1_P11 (SEQ ID NO:1317) sequence provides support for the deduced sequence of this variant protein according to the present invention).

TABLE 379

| Nucleic acid SNPs | | |
|---|---|---|
| SNP position on nucleotide sequence | Alternative nucleic acid | Previously known SNP? |
| 549 | A -> G | No |
| 648 | T -> G | No |
| 2720 | G -> A | Yes |
| 3228 | G -> C | Yes |
| 1025 | C -> | No |
| 1626 | T -> C | No |
| 2164 | T -> C | No |
| 2193 | G -> A | Yes |
| 2363 | G -> T | Yes |
| 2545 | T -> C | No |
| 2583 | G -> C | Yes |
| 2667 | G -> T | No |

As noted above, cluster Z44808 features 21 segment(s), which were listed in Table 368 above and for which the sequence(s) are given at the end of the application. These segment(s) are portions of nucleic acid sequence(s) which are described herein separately because they are of particular interest. A description of each segment according to the present invention is now provided.

Segment cluster Z44808_PEA_1_node_0 (SEQ ID NO:1255) according to the present invention is supported by 29 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 380 below describes the starting and ending position of this segment on each transcript.

TABLE 380

Segment location on transcripts

| Transcript name | Segment starting position | Segment ending position |
|---|---|---|
| Z44808_PEA_1_T11 (SEQ ID NO: 36) | 1 | 669 |
| Z44808_PEA_1_T4 (SEQ ID NO: 37) | 1 | 669 |
| Z44808_PEA_1_T5 (SEQ ID NO: 38) | 1 | 669 |
| Z44808_PEA_1_T8 (SEQ ID NO: 39) | 1 | 669 |
| Z44808_PEA_1_T9 (SEQ ID NO: 40) | 1 | 669 |

Segment cluster Z44808_PEA_1_node_16 (SEQ ID NO:1256) according to the present invention is supported by 39 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 381 below describes the starting and ending position of this segment on each transcript.

TABLE 381

Segment location on transcripts

| Transcript name | Segment starting position | Segment ending position |
|---|---|---|
| Z44808_PEA_1_T11 (SEQ ID NO: 36) | 1172 | 1358 |
| Z44808_PEA_1_T4 (SEQ ID NO: 37) | 1223 | 1409 |
| Z44808_PEA_1_T5 (SEQ ID NO: 38) | 1223 | 1409 |
| Z44808_PEA_1_T8 (SEQ ID NO: 39) | 1223 | 1409 |
| Z44808_PEA_1_T9 (SEQ ID NO: 40) | 1223 | 1409 |

Segment cluster Z44808_PEA_1_node_2 (SEQ ID NO:1257) according to the present invention is supported by 34 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 382 below describes the starting and ending position of this segment on each transcript.

TABLE 382

Segment location on transcripts

| Transcript name | Segment starting position | Segment ending position |
|---|---|---|
| Z44808_PEA_1_T11 (SEQ ID NO: 36) | 670 | 841 |
| Z44808_PEA_1_T4 (SEQ ID NO: 37) | 670 | 841 |
| Z44808_PEA_1_T5 (SEQ ID NO: 38) | 670 | 841 |
| Z44808_PEA_1_T8 (SEQ ID NO: 39) | 670 | 841 |
| Z44808_PEA_1_T9 (SEQ ID NO: 40) | 670 | 841 |

Segment cluster Z44808_PEA_1_node_24 (SEQ ID NO:1258) according to the present invention is supported by 52 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 383 below describes the starting and ending position of this segment on each transcript.

TABLE 383

Segment location on transcripts

| Transcript name | Segment starting position | Segment ending position |
|---|---|---|
| Z44808_PEA_1_T11 (SEQ ID NO: 36) | 1545 | 1819 |
| Z44808_PEA_1_T4 (SEQ ID NO: 37) | 1596 | 1870 |
| Z44808_PEA_1_T5 (SEQ ID NO: 38) | 1596 | 1870 |
| Z44808_PEA_1_T8 (SEQ ID NO: 39) | 1596 | 1870 |
| Z44808_PEA_1_T9 (SEQ ID NO: 40) | 1596 | 1870 |

Segment cluster Z44808_PEA_1_node_32 (SEQ ID NO:1259) according to the present invention is supported by 17 libraries. The number of libraries was determined as previously described. This segment can be found in the following transcript(s): Z44808_PEA_1_T4 (SEQ ID NO:37) and Z44808_PEA_1_T8 (SEQ ID NO:39). Table 384 below describes the starting and ending position of this segment on each transcript.

TABLE 384

Segment location on transcripts

| Transcript name | Segment starting position | Segment ending position |
|---|---|---|
| Z44808_PEA_1_T4 (SEQ ID NO: 37) | 1909 | 3593 |
| Z44808_PEA_1_T8 (SEQ ID NO: 39) | 1909 | 2397 |

Segment cluster Z44808_PEA_1_node_33 (SEQ ID NO:1260) according to the present invention is supported by 133 libraries. The number of libraries was determined as previously described. This segment can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 385 below describes the starting and ending position of this segment on each transcript.

TABLE 385

Segment location on transcripts

| Transcript name | Segment starting position | Segment ending position |
|---|---|---|
| Z44808_PEA_1_T11 (SEQ ID NO: 36) | 1858 | 2734 |
| Z44808_PEA_1_T4 (SEQ ID NO: 37) | 3594 | 4470 |
| Z44808_PEA_1_T5 (SEQ ID NO: 38) | 2004 | 2880 |

Segment cluster Z44808_PEA_1_node_36 (SEQ ID NO:1261) according to the present invention is supported by 117 libraries. The number of libraries was determined as previously described. This segment can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 386 below describes the starting and ending position of this segment on each transcript.

TABLE 386

Segment location on transcripts

| Transcript name | Segment starting position | Segment ending position |
|---|---|---|
| Z44808_PEA_1_T11 (SEQ ID NO: 36) | 2829 | 3080 |
| Z44808_PEA_1_T4 (SEQ ID NO: 37) | 4565 | 4816 |
| Z44808_PEA_1_T5 (SEQ ID NO: 38) | 2975 | 3226 |

Segment cluster Z44808_PEA_1_node_37 (SEQ ID NO:1262) according to the present invention is supported by 120 libraries. The number of libraries was determined as previously described. This segment can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 387 below describes the starting and ending position of this segment on each transcript.

TABLE 387

Segment location on transcripts

| Transcript name | Segment starting position | Segment ending position |
|---|---|---|
| Z44808_PEA_1_T11 (SEQ ID NO: 36) | 3081 | 3429 |
| Z44808_PEA_1_T4 (SEQ ID NO: 37) | 4817 | 5165 |
| Z44808_PEA_1_T5 (SEQ ID NO: 38) | 3227 | 3575 |

Segment cluster Z44808_PEA_1_node_41 (SEQ ID NO:1263) according to the present invention is supported by 2 libraries. The number of libraries was determined as previously described. This segment can be found in the following transcript(s): Z44808_PEA_1_T9 (SEQ ID NO:40). Table 388 below describes the starting and ending position of this segment on each transcript.

TABLE 388

Segment location on transcripts

| Transcript name | Segment starting position | Segment ending position |
|---|---|---|
| Z44808_PEA_1_T9 (SEQ ID NO: 40) | 1974 | 2206 |

According to an optional embodiment of the present invention, short segments related to the above cluster are also provided. These segments are up to about 120 bp in length, and so are included in a separate description.

Segment cluster Z44808_PEA_1_node_11 (SEQ ID NO:1264) according to the present invention is supported by 25 libraries. The number of libraries was determined as previously described. This segment can be found in the following transcript(s): Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 389 below describes the starting and ending position of this segment on each transcript.

TABLE 389

Segment location on transcripts

| Transcript name | Segment starting position | Segment ending position |
|---|---|---|
| Z44808_PEA_1_T4 (SEQ ID NO: 37) | 1097 | 1147 |
| Z44808_PEA_1_T5 (SEQ ID NO: 38) | 1097 | 1147 |
| Z44808_PEA_1_T8 (SEQ ID NO: 39) | 1097 | 1147 |
| Z44808_PEA_1_T9 (SEQ ID NO: 40) | 1097 | 1147 |

Segment cluster Z44808_PEA_1_node_13 (SEQ ID NO:1265) according to the present invention is supported by 28 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 390 below describes the starting and ending position of this segment on each transcript.

TABLE 390

Segment location on transcripts

| Transcript name | Segment starting position | Segment ending position |
|---|---|---|
| Z44808_PEA_1_T11 (SEQ ID NO: 36) | 1097 | 1171 |
| Z44808_PEA_1_T4 (SEQ ID NO: 37) | 1148 | 1222 |
| Z44808_PEA_1_T5 (SEQ ID NO: 38) | 1148 | 1222 |
| Z44808_PEA_1_T8 (SEQ ID NO: 39) | 1148 | 1222 |
| Z44808_PEA_1_T9 (SEQ ID NO: 40) | 1148 | 1222 |

Segment cluster Z44808_PEA_1_node_18 (SEQ ID NO:1266) according to the present invention is supported by 27 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808 PEA_1_T9 (SEQ ID NO:40). Table 391 below describes the starting and ending position of this segment on each transcript.

TABLE 391

Segment location on transcripts

| Transcript name | Segment starting position | Segment ending position |
| --- | --- | --- |
| Z44808_PEA_1_T11 (SEQ ID NO: 36) | 1359 | 1441 |
| Z44808_PEA_1_T4 (SEQ ID NO: 37) | 1410 | 1492 |
| Z44808_PEA_1_T5 (SEQ ID NO: 38) | 1410 | 1492 |
| Z44808_PEA_1_T8 (SEQ ID NO: 39) | 1410 | 1492 |
| Z44808_PEA_1_T9 (SEQ ID NO: 40) | 1410 | 1492 |

Segment cluster Z44808_PEA_1_node_22 (SEQ ID NO:1267) according to the present invention is supported by 33 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 392 below describes the starting and ending position of this segment on each transcript.

TABLE 392

Segment location on transcripts

| Transcript name | Segment starting position | Segment ending position |
| --- | --- | --- |
| Z44808_PEA_1_T11 (SEQ ID NO: 36) | 1442 | 1544 |
| Z44808_PEA_1_T4 (SEQ ID NO: 37) | 1493 | 1595 |
| Z44808_PEA_1_T5 (SEQ ID NO: 38) | 1493 | 1595 |
| Z44808_PEA_1_T8 (SEQ ID NO: 39) | 1493 | 1595 |
| Z44808_PEA_1_T9 (SEQ ID NO: 40) | 1493 | 1595 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to lung cancer), shown in Table 393.

TABLE 393

Oligonucleotides related to this segment

| Oligonucleotide name | Overexpressed in cancers | Chip reference |
| --- | --- | --- |
| Z44808_0_8_0 | Lung squamous cell carcinoma | LUN |

Segment cluster Z44808_PEA_1_node_26 (SEQ ID NO:1268) according to the present invention is supported by 2 libraries. The number of libraries was determined as previously described. This segment can be found in the following transcript(s): Z44808_PEA_1_T5 (SEQ ID NO:38). Table 394 below describes the starting and ending position of this segment on each transcript.

TABLE 394

Segment location on transcripts

| Transcript name | Segment starting position | Segment ending position |
| --- | --- | --- |
| Z44808_PEA_1_T5 (SEQ ID NO: 38) | 1871 | 1965 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to lung cancer), shown in Table 395.

TABLE 395

Oligonucleotides related to this segment

| Oligonucleotide name | Overexpressed in cancers | Chip reference |
| --- | --- | --- |
| Z44808_0_0_72347 | Lung small cell cancer | LUN |

Segment cluster Z44808_PEA_1_node_30 (SEQ ID NO:1269) according to the present invention is supported by 44 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 396 below describes the starting and ending position of this segment on each transcript.

TABLE 396

Segment location on transcripts

| Transcript name | Segment starting position | Segment ending position |
| --- | --- | --- |
| Z44808_PEA_1_T11 (SEQ ID NO: 36) | 1820 | 1857 |
| Z44808_PEA_1_T4 (SEQ ID NO: 37) | 1871 | 1908 |
| Z44808_PEA_1_T5 (SEQ ID NO: 38) | 1966 | 2003 |
| Z44808_PEA_1_T8 (SEQ ID NO: 39) | 1871 | 1908 |
| Z44808_PEA_1_T9 (SEQ ID NO: 40) | 1871 | 1908 |

Segment cluster Z44808_PEA_1_node_34 (SEQ ID NO:1270) according to the present invention is supported by 70 libraries. The number of libraries was determined as previously described. This segment can be found in the following transcript(s): Z44808_PEA_1_T111 (SEQ ID NO:36), Z44808_PEA_1_T4 (SEQ ID NO:37) and Z44808_PEA_1_T5 (SEQ ID NO:38). Table 397 below describes the starting and ending position of this segment on each transcript.

TABLE 397

Segment location on transcripts

| Transcript name | Segment starting position | Segment ending position |
|---|---|---|
| Z44808_PEA_1_T11 (SEQ ID NO: 36) | 2735 | 2809 |
| Z44808_PEA_1_T4 (SEQ ID NO: 37) | 4471 | 4545 |
| Z44808_PEA_1_T5 (SEQ ID NO: 38) | 2881 | 2955 |

Segment cluster Z44808_PEA_1_node_35 (SEQ ID NO:1271) according to the present invention can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 398 below describes the starting and ending position of this segment on each transcript.

TABLE 398

Segment location on transcripts

| Transcript name | Segment starting position | Segment ending position |
|---|---|---|
| Z44808_PEA_1_T11 (SEQ ID NO: 36) | 2810 | 2828 |
| Z44808_PEA_1_T4 (SEQ ID NO: 37) | 4546 | 4564 |
| Z44808_PEA_1_T5 (SEQ ID NO: 38) | 2956 | 2974 |

Segment cluster Z44808_PEA_1_node_39 (SEQ ID NO:1272) according to the present invention is supported by 1 libraries. The number of libraries was determined as previously described. This segment can be found in the following transcript(s): Z44808_PEA_1_T9 (SEQ ID NO:40). Table 399 below describes the starting and ending position of this segment on each transcript.

TABLE 399

Segment location on transcripts

| Transcript name | Segment starting position | Segment ending position |
|---|---|---|
| Z44808_PEA_1_T9 (SEQ ID NO: 40) | 1909 | 1973 |

Segment cluster Z44808_PEA_1_node_4 (SEQ ID NO:1273) according to the present invention is supported by 33 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 400 below describes the starting and ending position of this segment on each transcript.

TABLE 400

Segment location on transcripts

| Transcript name | Segment starting position | Segment ending position |
|---|---|---|
| Z44808_PEA_1_T11 (SEQ ID NO: 36) | 842 | 948 |
| Z44808_PEA_1_T4 (SEQ ID NO: 37) | 842 | 948 |
| Z44808_PEA_1_T5 (SEQ ID NO: 38) | 842 | 948 |
| Z44808_PEA_1_T8 (SEQ ID NO: 39) | 842 | 948 |
| Z44808_PEA_1_T9 (SEQ ID NO: 40) | 842 | 948 |

Segment cluster Z44808_PEA_1_node_6 (SEQ ID NO:1274) according to the present invention is supported by 30 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 401 below describes the starting and ending position of this segment on each transcript.

TABLE 401

Segment location on transcripts

| Transcript name | Segment starting position | Segment ending position |
|---|---|---|
| Z44808_PEA_1_T11 (SEQ ID NO: 36) | 949 | 1048 |
| Z44808_PEA_1_T4 (SEQ ID NO: 37) | 949 | 1048 |
| Z44808_PEA_1_T5 (SEQ ID NO: 38) | 949 | 1048 |
| Z44808_PEA_1_T8 (SEQ ID NO: 39) | 949 | 1048 |
| Z44808_PEA_1_T9 (SEQ ID NO: 40) | 949 | 1048 |

Segment cluster Z44808_PEA_1_node_8 (SEQ ID NO:1275) according to the present invention is supported by 25 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 402 below describes the starting and ending position of this segment on each transcript.

TABLE 402

Segment location on transcripts

| Transcript name | Segment starting position | Segment ending position |
|---|---|---|
| Z44808_PEA_1_T11 (SEQ ID NO: 36) | 1049 | 1096 |
| Z44808_PEA_1_T4 (SEQ ID NO: 37) | 1049 | 1096 |
| Z44808_PEA_1_T5 (SEQ ID NO: 38) | 1049 | 1096 |
| Z44808_PEA_1_T8 (SEQ ID NO: 39) | 1049 | 1096 |

TABLE 402-continued

Segment location on transcripts

| Transcript name | Segment starting position | Segment ending position |
|---|---|---|
| Z44808_PEA_1_T9 (SEQ ID NO: 40) | 1049 | 1096 |

Variant Protein Alignment to the Previously Known Protein:
Sequence name: /tmp/vUqLu6eAVZ/K3JDuPvaLo: SMO2_HUMAN (SEQ ID NO:1430)

Sequence documentation:
Alignment of: Z44808_PEA_1_P5 (SEQ ID NO:1314) x SMO2_HUMAN (SEQ ID NO:1430) ..
Alignment segment 1/1:

| | | | |
|---|---|---|---|
| Quality: | 4440.00 | | |
| Escore: | 0 | | |
| Matching length: | 441 | Total length: | 441 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300

301 LQGCPGAKKHEFLTSVLDALSTDMVHAASDPSSSSGRLSEPDPSHTLEER 350
    ||||||||||||||||||||||||||||||||||||||||||||||||||
301 LQGCPGAKKHEFLTSVLDALSTDMVHAASDPSSSSGRLSEPDPSHTLEER 350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400

401 DKSISVQELMGCLGVAKEDGKADTKKRHTPRGHAESTSNRQ           441
    ||||||||||||||||||||||||||||||||||||||||
401 DKSISVQELMGCLGVAKEDGKADTKKRHTPRGHAESTSNRQ           441
```

Sequence name: /tmp/QSUNfTsJ5y/kLOw5Vb6SD: SMO2_HUMAN (SEQ ID NO:1430)
Sequence documentation:
Alignment of: Z44808_PEA__1_P6 (SEQ ID NO:1315) x SM02_HUMAN (SEQ ID NO:1430) ..
Alignment segment 1/1:

| | |
|---|---|
| Quality: | 4310.00 |
| Escore: | 0 |
| Matching length: | 428 |
| Total length: | 428 |
| Matching Percent Similarity: | 100.00 |
| Matching Percent Identity: | 100.00 |
| Total Percent Similarity: | 100.00 |
| Total Percent Identity: | 100.00 |
| Gaps: | 0 |

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300

301 LQGCPGAKKHIFLTSVLDALSTDMVHAASDPSSSSGRLSEPDPSHTLEER 350
    ||||||||||||||||||||||||||||||||||||||||||||||||||
301 LQGCPGAKKHIFLTSVLDALSTDMVHAASDPSSSSGRLSEPDPSHTLEER 350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400

401 DKSISVQELMGCLGVAKEDGKADTKKRH                      428
    ||||||||||||||||||||||||||||
401 DKSISVQELMGCLGVAKEDGKADTKKRH                      428
```

Sequence name: /tmp/MZVdR4PVdM/5uN8RwViJ1: SMO2_HUMAN (SEQ ID NO:1430)

Sequence documentation:
Alignment of: Z44808_PEA_1_P7 (SEQ ID NO:1316) x SMO2_HUMAN (SEQ ID NO:1430) ..

Alignment segment 1/1:

| | | | |
|---|---|---|---|
| Quality: | 4440.00 | | |
| Escore: | 0 | | |
| Matching length: | 441 | Total length: | 441 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300

301 LQGCPGAKKHEFLTSVLDALSTDMVHAASDPSSSSGRLSEPDPSHTLEER 350
    ||||||||||||||||||||||||||||||||||||||||||||||||||
301 LQGCPGAKKHEFLTSVLDALSTDMVHAASDPSSSSGRLSEPDPSHTLEER 350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400

401 DKSISVQELMGCLGVAKEDGKADTKKRHTPRGHAESTSNRQ          441
    |||||||||||||||||||||||||||||||||||||||||
401 DKSISVQELMGCLGVAKEDGKADTKKRHTPRGHAESTSNRQ          441
```

Sequence name: /tmp/3fGVxqLloe/J5mQduAd0F: SMO2_HUMAN (SEQ ID NO:1430)

Sequence documentation:

Alignment of: Z44808_PEA__1_P11 (SEQ ID NO:1317) x SMO2_HUMAN (SEQ ID NO:1430) ..

Alignment segment 1/1:

| | | | |
|---|---|---|---|
| Quality: | 4228.00 | | |
| Escore: | 0 | | |
| Matching length: | 429 | Total length: | 446 |
| Matching Percent Similarity: | 100.00 | Matching Percent Identity: | 100.00 |
| Total Percent Similarity: | 96.19 | Total Percent Identity: | 96.19 |
| Gaps: | 1 | | |

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKT.................DIASRYPTLWTEQ 183
    ||||||||||||||||||||                 |||||||||||||
151 PRCPGSVNEKLPQREGTGKTDDAAAPALETQPQGDEEDIASRYPTLWTEQ 200

184 VKSRQNKTNKNSVSSCDQEHQSALEEAKQPKNDNVVIPECAHGGLYKPVQ 233
    ||||||||||||||||||||||||||||||||||||||||||||||||||
201 VKSRQNKTNKNSVSSCDQEHQSALEEAKQPKNDNVVIPECAHGGLYKPVQ 250

234 CHPSTGYCWCVLVDTGRPIPGTSTRYEQPKCDNTARAHPAKARDLYKGRQ 283
    ||||||||||||||||||||||||||||||||||||||||||||||||||
251 CHPSTGYCWCVLVDTGRPIPGTSTRYEQPKCDNTARAHPAKARDLYKGRQ 300

284 LQGCPGAKKHEFLTSVLDALSTDMVHAASDPSSSSGRLSEPDPSHTLEER 333
    ||||||||||||||||||||||||||||||||||||||||||||||||||
301 LQGCPGAKKHEFLTSVLDALSTDMVHAASDPSSSSGRLSEPDPSHTLEER 350

334 VVHWYFKLLDKNSSGDIGKKEIKPFKRFLRKKSKPKKCVKKFVEYCDVNN 383
    ||||||||||||||||||||||||||||||||||||||||||||||||||
351 VVHWYFKLLDKNSSGDIGKKEIKPFKRFLRKKSKPKKCVKKFVEYCDVNN 400

384 DKSISVQELMGCLGVAKEDGKADTKKRHTPRGHAESTSNRQPRKQG     429
    ||||||||||||||||||||||||||||||||||||||||||||||
401 DKSISVQELMGCLGVAKEDGKADTKKRHTPRGHAESTSNRQPRKQG     446
```

Expression of SMO2_HUMAN SPARC Related Modular Calcium-binding Protein 2 Precursor Z44808 Transcripts which are Detectable by Amplicon as Depicted in Sequence Name Z44808junc8-11 (SEQ ID NO: 1651) in normal and cancerous lung tissues Expression of SMO2_HUMAN SPARC related modular calcium-binding protein 2 precursor (Secreted modular calcium-binding protein 2) (SMOC-2) (Smooth muscle-associated protein 2) transcripts detectable by or according to junc8-11, Z44808 junc8-11 amplicon (SEQ ID NO: 1651) and Z44808junc8-11F (SEQ ID NO:1649) and Z44808junc8-11R (SEQ ID NO: 1650) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 29:
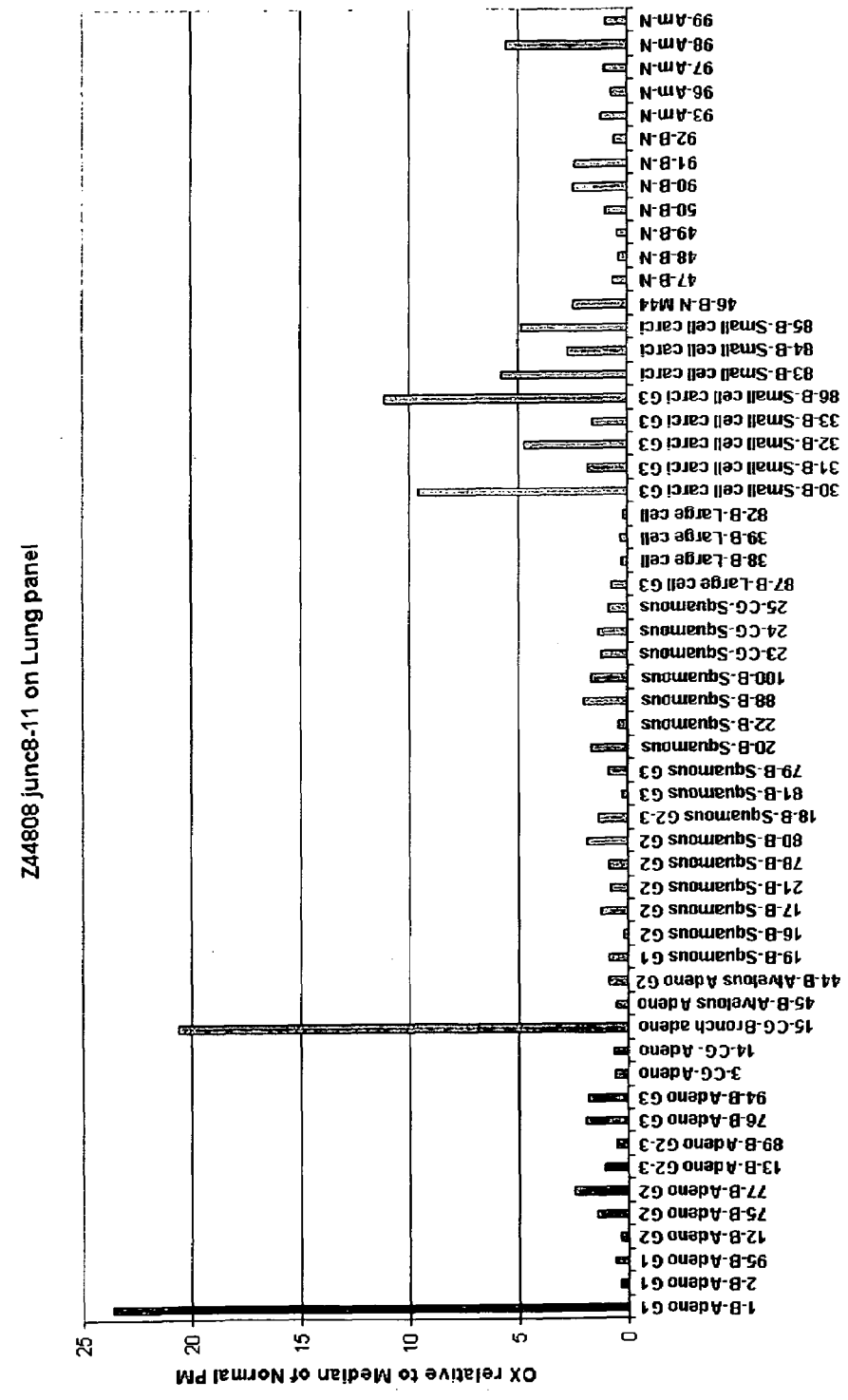
FIG. 29 is a histogram showing over expression of the SMO2_HUMAN SPARC related modular calcium-binding protein 2 Z44808 transcripts, which are detectable by amplicon as depicted in sequence name Z44808junc8-11 (SEQ ID NO:1651), in cancerous lung samples relative to the normal samples.

FIG. 29 is a histogram showing over expression of the above-indicated SMO2_HUMAN SPARC related modular calcium-binding protein 2 precursor transcripts in cancerous lung samples relative to the normal samples.

As is evident from FIG. 29, the expression of SMO2_HUMAN SPARC related modular calcium-binding protein 2 precursor transcripts detectable by the above amplicon in several cancer samples was significantly higher than in the non-cancerous samples (Sample Nos. 47-50, 90-93, 96-99 Table 2, "Tissue samples in testing panel"). Notably an over-expression of at least 5 fold was found in 2 out of 15 adenocarcinoma samples and in 3 out of 8 small cells carcinoma samples.

Primer pairs are also optionally and preferably encompassed within the present invention; for example, for the above experiment, the following primer pair was used as a non-limiting illustrative example only of a suitable primer pair: Z44808junc8-11F forward primer (SEQ ID NO:1649); and Z44808junc8-11R reverse primer (SEQ ID NO:1650).

The present invention also preferably encompasses any amplicon obtained through the use of any suitable primer pair; for example, for the above experiment, the following amplicon was obtained as a non-limiting illustrative example only of a suitable amplicon: Z44808junc8-11 (SEQ ID NO: 1651)

Forward primer
(SEQ ID NO:1649)
GAAGGCACAGGAAAAACAGATATTG:

Reverse primer
(SEQ ID NO:1650)
TGGTGCTCTTGGTCACAGGAT:

Amplicon
(SEQ ID NO:1651)

-continued
GAAGGCACAGGAAAAACAGATATTGCATCACGTTACCCTACCCTTTGGAC
TGAACAGGTTAAAAGTCGGCAGAACAAAACCAATAAGAATTCAGTGTCAT
CCTGTGACCAAGAGCACCA:

Expression of SMO2_HUMAN SPARC Related Modular Calcium-binding Protein 2 Precursor Secreted Modular Calcium-binding Protein 2) (SMOC-2) (Smooth Muscle-associated Protein 2) Z44808 Transcripts which are Detectable by Amplicon as Depicted in Sequence Name Z44808 Junc8-11 (SEQ ID NO: 1651) in Different Normal Tissues Expression of SMO2_HUMAN SPARC related modular calcium-binding protein 2 precursor (Secreted modular calcium-binding protein 2) (SMOC-2) (Smooth muscle-associated protein 2) transcripts detectable by or according to Z44808junc8-11 amplicon (SEQ ID NO: 1651) and primers: Z44808junc8-11F (SEQ ID NO:1649) and Z44808junc8-11R (SEQ ID NO: 1650) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 3), to obtain a value of relative expression of each sample relative to median of the ovary samples.

Figure 18:
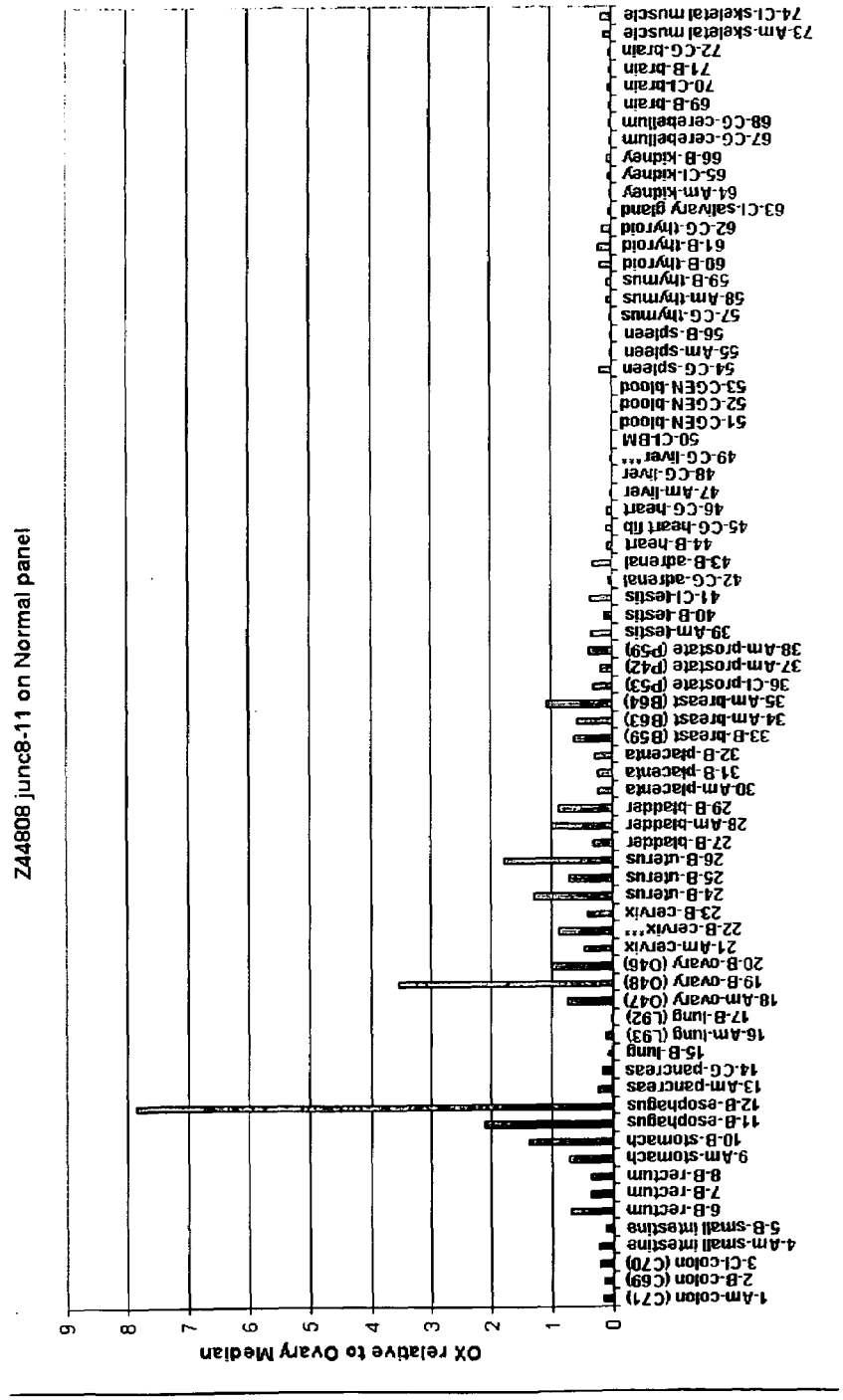
FIG. 18 is a histogram showing the expression of SMO2_HUMAN SPARC related modular calcium-binding protein 2 precursor (Secreted modular calcium-binding protein 2) (SMOC-2) (Smooth muscle-associated protein 2) Z44808 transcripts which are detectable by amplicon as depicted in sequence name Z44808 junc8-11 (SEQ ID NO: 1651) in different normal tissues.

Primers:

Forward primer
(SEQ ID NO:1649)
GAAGGCACAGGAAAAACAGATATTG:

Reverse primer
(SEQ ID NO:1650)
TGGTGCTCTTGGTCACAGGAT:

Amplicon
(SEQ ID NO:1651)
GAAGGCACAGGAAAAACAGATATTGCATCACGTTACCCTACCCTTTGGAC
TGAACAGGTTAAAAGTCGGCAGAACAAAACCAATAAGAATTCAGTGTCAT
CCTGTGACCAAGAGCACCA:

The results are demonstrated in FIG. 18, showing the expression of SMO2_HUMAN SPARC related modular calcium-binding protein 2 precursor (Secreted modular calcium-binding protein 2) (SMOC-2) (Smooth muscle-associated protein 2) Z44808 transcripts which are detectable by amplicon as depicted in sequence name Z44808 junc8-11 (SEQ ID NO:1651) in different normal tissues.

Description for Cluster AA161187

Cluster AA161187 features 7 transcript(s) and 20 segment(s) of interest, the names for which are given in Tables 403 and 404, respectively, the sequences themselves are given at the end of the application. The selected protein variants are given in table 405.

TABLE 403

Transcripts of interest

| Transcript Name | Sequence ID No. |
| --- | --- |
| AA161187_T0 | 41 |
| AA161187_T7 | 42 |
| AA161187_T15 | 43 |
| AA161187_T16 | 44 |
| AA161187_T20 | 45 |
| AA161187_T21 | 46 |
| AA161187_T22 | 47 |

TABLE 404

Segments of interest

| Segment Name | Sequence ID No. |
| --- | --- |
| AA161187_node_0 | 482 |
| AA161187_node_6 | 483 |
| AA161187_node_14 | 484 |
| AA161187_node_16 | 485 |
| AA161187_node_25 | 486 |
| AA161187_node_26 | 487 |
| AA161187_node_28 | 488 |
| AA161187_node_4 | 489 |
| AA161187_node_7 | 490 |
| AA161187_node_8 | 491 |
| AA161187_node_9 | 492 |
| AA161187_node_10 | 493 |
| AA161187_node_12 | 494 |
| AA161187_node_13 | 495 |
| AA161187_node_19 | 496 |
| AA161187_node_20 | 497 |
| AA161187_node_21 | 498 |
| AA161187_node_22 | 499 |
| AA161187_node_23 | 500 |
| AA161187_node_24 | 501 |

TABLE 405

Proteins of interest

| Protein Name | Sequence ID No. | Corresponding Transcript(s) |
| --- | --- | --- |
| AA161187_P1 | 1318 | AA161187_T0 (SEQ ID NO: 41) |
| AA161187_P6 | 1319 | AA161187_T7 (SEQ ID NO: 42) |
| AA161187_P13 | 1320 | AA161187_T15 (SEQ ID NO: 43) |
| AA161187_P14 | 1321 | AA161187_T16 (SEQ ID NO: 44) |
| AA161187_P18 | 1322 | AA161187_T20 (SEQ ID NO: 45) |
| AA161187_P19 | 1323 | AA161187_T21 (SEQ ID NO: 46) |

These sequences are variants of the known protein Testisin precursor (SwissProt accession identifier TEST_HUMAN; known also according to the synonyms EC 3.4.21.-; Eosinophil serine protease 1; ESP-1; UNQ266/PRO303), SEQ ID NO:1431, referred to herein as the previously known protein.

Protein Testisin precursor (SEQ ID NO:1431) is known or believed to have the following function(s): Could regulate proteolytic events associated with testicular germ cell maturation. The sequence for protein Testisin precursor is given at the end of the application, as "Testisin precursor amino acid sequence". Protein Testisin precursor localization is believed to be attached to the membrane by a GPI-anchor.

The following GO Annotation(s) apply to the previously known protein. The following annotation(s) were found: serine-type peptidase, which are annotation(s) related to Molecular Function; and membrane fraction; cytoplasm; plasma membrane, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster AA161187 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 30 refer to weighted expression of ESTs in each category, as "parts per million" (ratio of the expression of ESTs for a particular cluster to the expression of all ESTs in that category, according to parts per million).

Figure 30:
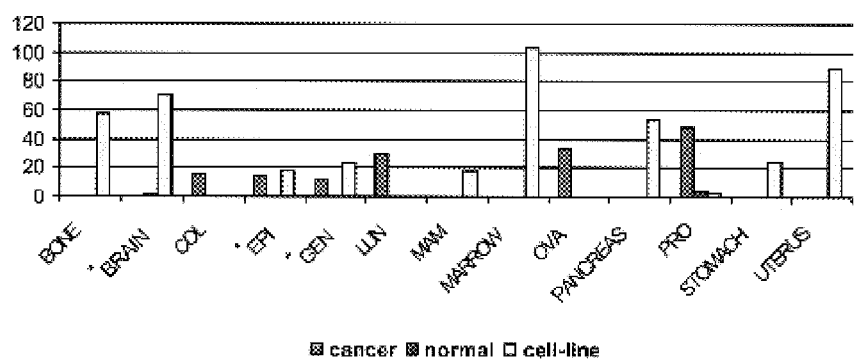
FIG. 30 is a histogram showing Cancer and cell-line vs. normal tissue expression for Cluster AA161187, demonstrating overexpression in brain malignant tumors, epithelial malignant tumors and a mixture of malignant tumors from different tissues.

Overall, the following results were obtained as shown with regard to the histograms in FIG. 30 and Table 406. This cluster is overexpressed (at least at a minimum level) in the following pathological conditions: brain malignant tumors, epithelial malignant tumors and a mixture of malignant tumors from different tissues.

TABLE 406

Normal tissue distribution

| Name of Tissue | Number |
| --- | --- |
| bone | 0 |
| brain | 1 |
| colon | 0 |
| epithelial | 0 |
| general | 0 |
| lung | 0 |
| breast | 0 |
| bone marrow | 0 |
| ovary | 0 |
| pancreas | 0 |
| prostate | 4 |
| stomach | 0 |
| uterus | 0 |

TABLE 407

P values and ratios for expression in cancerous tissue

| Name of Tissue | P1 | P2 | SP1 | R3 | SP2 | R4 |
| --- | --- | --- | --- | --- | --- | --- |
| bone | 1 | 6.7e−01 | 1 | 1.0 | 3.4e−01 | 1.9 |
| brain | 9.8e−01 | 6.0e−01 | 1 | 0.7 | 3.8e−03 | 3.6 |
| colon | 4.4e−01 | 5.0e−01 | 7.0e−01 | 1.5 | 7.7e−01 | 1.3 |
| epithelial | 1.3e−02 | 2.6e−03 | 1.7e−03 | 8.4 | 2.4e−04 | 7.9 |
| general | 1.6e−03 | 1.9e−05 | 1.9e−05 | 12.1 | 2.9e−10 | 15.6 |
| lung | 5.0e−01 | 6.3e−01 | 1.7e−01 | 3.9 | 3.8e−01 | 2.2 |
| breast | 1 | 6.7e−01 | 1 | 1.0 | 8.2e−01 | 1.2 |
| bone marrow | 1 | 4.2e−01 | 1 | 1.0 | 1.5e−01 | 2.9 |
| ovary | 6.2e−01 | 6.5e−01 | 4.7e−01 | 1.9 | 5.9e−01 | 1.6 |
| pancreas | 1 | 4.4e−01 | 1 | 1.0 | 2.8e−01 | 2.8 |
| prostate | 5.9e−01 | 5.9e−01 | 1.4e−01 | 2.9 | 2.4e−01 | 2.3 |
| stomach | 1 | 4.7e−01 | 1 | 1.0 | 6.4e−01 | 1.5 |
| uterus | 1 | 2.4e−01 | 1 | 1.0 | 1.7e−01 | 2.0 |

As noted above, cluster AA161187 features 7 transcript(s), which were listed in Table 403 above. These transcript(s) encode for protein(s) which are variant(s) of protein Testisin precursor (SEQ ID NO:1431). A description of each variant protein according to the present invention is now provided.

Variant protein AA161187_P1 (SEQ ID NO:1318) according to the present invention has an amino acid sequence as given at the end of the application; it is encoded by transcript(s) AA161187_T0 (SEQ ID NO:41). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein AA161187_P1 (SEQ ID NO:1318) also has the following non-silent SNPs (Single Nucleotide Polymorphisms) as listed in Table 408, (given according to their position(s) on the amino acid sequence, with the alternative amino acid(s) listed; the last column indicates whether the SNP is known or not; the presence of known SNPs in variant protein AA161187_P1 (SEQ ID NO:1318) sequence provides support for the deduced sequence of this variant protein according to the present invention).

TABLE 408

Amino acid mutations

| SNP position(s) on amino acid sequence | Alternative amino acid(s) | Previously known SNP? |
|---|---|---|
| 1 | M -> | No |
| 16 | A -> | No |
| 226 | N -> | No |
| 253 | I -> V | No |
| 255 | V -> I | No |
| 264 | R -> | No |
| 264 | R -> P | No |
| 264 | R -> Q | Yes |

Variant protein AA161187_P1 (SEQ ID NO:1318) is encoded by the following transcript(s): AA161187_T0 (SEQ ID NO:41), for which the sequence(s) is/are given at the end of the application. The coding portion of transcript AA161187_T0 (SEQ ID NO:41) is shown in bold; this coding portion starts at position 107 and ends at position 1048. The transcript also has the following SNPs as listed in Table 409 (given according to their position on the nucleotide sequence, with the alternative nucleic acid listed; the last column indicates whether the SNP is known or not; the presence of known SNPs in variant protein AA161187_P1 (SEQ ID NO:1318) sequence provides support for the deduced sequence of this variant protein according to the present invention).

TABLE 409

Nucleic acid SNPs

| SNP position on nucleotide sequence | Alternative nucleic acid | Previously known SNP? |
|---|---|---|
| 66 | T -> A | No |
| 67 | T -> G | No |
| 105 | C -> T | No |
| 108 | T -> | No |
| 154 | T -> | No |
| 190 | C -> G | No |
| 469 | A -> G | Yes |
| 571 | C -> T | Yes |
| 782 | A -> | No |
| 859 | T -> C | Yes |
| 863 | A -> G | No |
| 869 | G -> A | No |
| 897 | G -> | No |
| 897 | G -> A | Yes |

TABLE 409-continued

Nucleic acid SNPs

| SNP position on nucleotide sequence | Alternative nucleic acid | Previously known SNP? |
|---|---|---|
| 897 | G -> C | No |
| 1000 | A -> G | Yes |
| 1068 | G -> | No |
| 1068 | G -> A | No |
| 1069 | C -> A | No |
| 1168 | A -> G | Yes |

Variant protein AA161187_P6 (SEQ ID NO:1319) according to the present invention has an amino acid sequence as given at the end of the application; it is encoded by transcript(s) AA161187_T7 (SEQ ID NO:42). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison Report Between AA161187_P6 (SEQ ID NO:1319) and TEST_HUMAN (SEQ ID NO:1431):

1. An isolated chimeric polypeptide encoding for AA161187_P6 (SEQ ID NO:1319), comprising a first amino acid sequence being at least 70%, optionally at least 80%, preferably at least 85%, more preferably at least 90% and most preferably at least 95% homologous to a polypeptide having the sequence HTREGTLGGQKRAFPDGVEGEKGRGRAWGAASRGSAVPLTIR (SEQ ID NO: 273) corresponding to amino acids 1-42 of AA161187_P6 (SEQ ID NO:1319), and a second amino acid sequence being at least 90% homologous to GPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNH LFLKYSFRKDIFGDMVCAGNAQGGKDACFGDSGGPLACNKNGLWYQIGVVSWGVGC GRPNRPGVYTNISHHFEWIQKLMAQSGMSQPDPSWPLLFFPLLWALPLLGPV corresponding to amino acids 31-314 of TEST_HUMAN (SEQ ID NO:1431), which also corresponds to amino acids 43-326 of AA 161187_P6 (SEQ ID NO:1319), wherein said first amino acid sequence and second amino acid sequence are contiguous and in a sequential order.

2. An isolated polypeptide encoding for a head of AA161187_P6 (SEQ ID NO:1319), comprising a polypeptide being at least 70%, optionally at least about 80%, preferably at least about 85%, more preferably at least about 90% and most preferably at least about 95% homologous to the sequence HTREGTLGGQKRAFPDGVEGEKGRGRAWGAASRGSAVPLTIR (SEQ ID NO: 273) of AA161187_P6 (SEQ ID NO:1319).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein AA161187_P6 (SEQ ID NO:1319) also has the following non-silent SNPs (Single Nucleotide Polymorphisms) as listed in Table 410, (given according to their position(s) on the amino acid sequence, with the alternative amino acid(s) listed; the last column indicates whether the SNP is known or not; the presence of known SNPs in variant protein AA161187_P6 (SEQ ID NO:1319) sequence provides support for the deduced sequence of this variant protein according to the present invention).

TABLE 410

Amino acid mutations

| SNP position(s) on amino acid sequence | Alternative amino acid(s) | Previously known SNP? |
|---|---|---|
| 238 | N -> | No |
| 265 | I -> V | No |
| 267 | V -> I | No |
| 276 | R -> | No |
| 276 | R -> P | No |
| 276 | R -> Q | Yes |

The glycosylation sites of variant protein AA161187_P6 (SEQ ID NO:1319), as compared to the known protein Testisin precursor (SEQ ID NO:1431), are described in Table 411 (given according to their position(s) on the amino acid sequence in the first column; the second column indicates whether the glycosylation site is present in the variant protein; and the last column indicates whether the position is different on the variant protein).

TABLE 411

Glycosylation site(s)

| Position(s) on known amino acid sequence | Present in variant protein? | Position in variant protein? |
|---|---|---|
| 200 | yes | 212 |
| 167 | yes | 179 |
| 273 | yes | 285 |

Variant protein AA161187_P6 (SEQ ID NO:1319) is encoded by the following transcript(s): AA161187_T7 (SEQ ID NO:42), for which the sequence(s) is/are given at the end of the application. The coding portion of transcript AA161187_T7 (SEQ ID NO:42) is shown in bold; this coding portion starts at position 1 and ends at position 979. The transcript also has the following SNPs as listed in Table 412 (given according to their position on the nucleotide sequence, with the alternative nucleic acid listed; the last column indicates whether the SNP is known or not; the presence of known SNPs in variant protein AA161187_P6 (SEQ ID NO:1319) sequence provides support for the deduced sequence of this variant protein according to the present invention).

TABLE 412

Nucleic acid SNPs

| SNP position on nucleotide sequence | Alternative nucleic acid | Previously known SNP? |
|---|---|---|
| 400 | A -> G | Yes |
| 502 | C -> T | Yes |
| 713 | A -> | No |
| 790 | T -> C | Yes |
| 794 | A -> G | No |
| 800 | G -> A | No |
| 828 | G -> | No |
| 828 | G -> A | Yes |
| 828 | G -> C | No |

TABLE 412-continued

Nucleic acid SNPs

| SNP position on nucleotide sequence | Alternative nucleic acid | Previously known SNP? |
|---|---|---|
| 931 | A -> G | Yes |
| 999 | G -> | No |
| 999 | G -> A | No |
| 1000 | C -> A | No |
| 1099 | A -> G | Yes |

Variant protein AA161187_P13 (SEQ ID NO:1320) according to the present invention has an amino acid sequence as given at the end of the application; it is encoded by transcript(s) AA161187_T15 (SEQ ID NO:43). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison Report Between AA161187_P13 (SEQ ID NO:1320) and TEST_HUMAN (SEQ ID NO:1431):

1. An isolated chimeric polypeptide encoding for AA161187_P13 (SEQ ID NO:1320), comprising a first amino acid sequence being at least 90% homologous to MGARGALLLALLLARAGLRKPESQEAA-PLSGPCGRRVITSRIVGGEDAELGRWPWQGS LRLWD-SHVCGVSLLSHRWALTAAHCFETYSDLS-DPSGWMVQFGQLTSMPSFWSLQAY YTRYFVSNIYLSPRYLGNSPYDIALVKL-SAPVTYTKHIQPICLQASTFEFENRTDCWVTG WGY-IKEDE corresponding to amino acids 1-183 of TEST_HUMAN (SEQ ID NO:1431), which also corresponds to amino acids 1-183 of AA161187_P13 (SEQ ID NO:1320), and a second amino acid sequence being at least 70%, optionally at least 80%, preferably at least 85%, more preferably at least 90% and most preferably at least 95% homologous to a polypeptide having the sequence GSSGRHHKQLYVQP-PLPQVQFPQGHLWRHG (SEQ ID NO: 274) corresponding to amino acids 184-213 of AA161187_P13 (SEQ ID NO:1320), wherein said first amino acid sequence and second amino acid sequence are contiguous and in a sequential order.

2. An isolated polypeptide encoding for a tail of AA161187_P13 (SEQ ID NO:1320), comprising a polypeptide being at least 70%, optionally at least about 80%, preferably at least about 85%, more preferably at least about 90% and most preferably at least about 95% homologous to the sequence GSSGRHHKQLYVQPPLPQVQFPQGHLWRHG (SEQ ID NO: 274) in AA161187_P13 (SEQ ID NO:1320).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA161187_P13 (SEQ ID NO:1320) also has the following non-silent SNPs (Single Nucleotide Polymorphisms) as listed in Table 413, (given according to their position(s) on the amino acid sequence, with the alternative amino acid(s) listed; the last column indicates whether the SNP is known or not; the presence of known SNPs in variant protein AA161187_P13 (SEQ ID NO:1320) sequence provides support for the deduced sequence of this variant protein according to the present invention).

TABLE 413

Amino acid mutations

| SNP position(s) on amino acid sequence | Alternative amino acid(s) | Previously known SNP? |
|---|---|---|
| 1 | M -> | No |
| 16 | A -> | No |

The glycosylation sites of variant protein AA161187_P13 (SEQ ID NO:1320), as compared to the known protein Testisin precursor (SEQ ID NO:1431), are described in Table 414 (given according to their position(s) on the amino acid sequence in the first column; the second column indicates whether the glycosylation site is present in the variant protein; and the last column indicates whether the position is different on the variant protein).

TABLE 414

Glycosylation site(s)

| Position(s) on known amino acid sequence | Present in variant protein? | Position in variant protein? |
|---|---|---|
| 200 | no | |
| 167 | yes | 167 |
| 273 | no | |

Variant protein AA161187_P13 (SEQ ID NO:1320) is encoded by the following transcript(s): AA161187_T15 (SEQ ID NO:43), for which the sequence(s) is/are given at the end of the application. The coding portion of transcript AA161187 T15 (SEQ ID NO:43) is shown in bold; this coding portion starts at position 107 and ends at position 745. The transcript also has the following SNPs as listed in Table 415 (given according to their position on the nucleotide sequence, with the alternative nucleic acid listed; the last column indicates whether the SNP is known or not; the presence of known SNPs in variant protein AA161187_P13 (SEQ ID NO:1320) sequence provides support for the deduced sequence of this variant protein according to the present invention).

TABLE 415

| Nucleic acid SNPs | | |
|---|---|---|
| SNP position on nucleotide sequence | Alternative nucleic acid | Previously known SNP? |
| 66 | T -> A | No |
| 67 | T -> G | No |
| 105 | C -> T | No |
| 108 | T -> | No |
| 154 | T -> | No |
| 190 | C -> G | No |
| 469 | A -> G | Yes |
| 571 | C -> T | Yes |
| 791 | T -> C | Yes |
| 795 | A -> G | No |
| 801 | G -> A | No |
| 829 | G -> | No |
| 829 | G -> A | Yes |
| 829 | G -> C | No |
| 932 | A -> G | Yes |
| 1000 | G -> | No |

TABLE 415-continued

| Nucleic acid SNPs | | |
|---|---|---|
| SNP position on nucleotide sequence | Alternative nucleic acid | Previously known SNP? |
| 1000 | G -> A | No |
| 1001 | C -> A | No |
| 1100 | A -> G | Yes |

Variant protein AA161187_P14 (SEQ ID NO:1321) according to the present invention has an amino acid sequence as given at the end of the application; it is encoded by transcript(s) AA161187_T16 (SEQ ID NO:44). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison Report Between AA161187_P14 (SEQ ID NO:1321) and TEST_HUMAN (SEQ ID NO:1431):

1. An isolated chimeric polypeptide encoding for AA161187_P14 (SEQ ID NO:1321) comprising a first amino acid sequence being at least 90% homologous to MGAR-GALLLALLLARAGLRKPESQEAAPLSG-PCGRRVITSRIVGGEDAELGRWPWQGS LRLWDSH-VCGVSLLSHRWALTAAHCFETYSDLSDPSGWMVQF GQLTSMPSFWSLQAY YTRYFVSNIYLSPRYLGNSPY-DIALVKLSAPVTYTKHIQPICLQAST-FEFENRTDCWVTG WGYIKEDE corresponding to amino acids 1-183 of TEST_HUMAN (SEQ ID NO:1431), which also corresponds to amino acids 1-183 of AA61187_P14 (SEQ ID NO:1321), and a second amino acid sequence being at least 70%, optionally at least 80%, preferably at least 85%, more preferably at least 90% and most preferably at least 95% homologous to a polypeptide having the sequence GCCLSP-SHYRPHSTAISPHPPGSSGRHHKQLY-VQPPLPQVQFPQGHLWRHGLCWQCPRR EGCLL-RECPCHHSQPRKASCVPVPYLTLMPTPGGGDCCPT LQMQKRRLGCCQGEEEDV HPVYPAP (SEQ ID NO: 275) corresponding to amino acids 184-307 of AA161187_P14 (SEQ ID NO:1321), wherein said first amino acid sequence and second amino acid sequence are contiguous and in a sequential order.

2. An isolated polypeptide encoding for a tail of AA161187_P14 (SEQ ID NO:1321), comprising a polypeptide being at least 70%, optionally at least about 80%, preferably at least about 85%, more preferably at least about 90% and most preferably at least about 95% homologous to the sequence GCCLSPSHYRPHSTAISPHPPGSSGRHH-KQLYVQPPLPQVQFPQGHLWRHGLCWQCPRR EGCLLRECPCHHSQPRKAS-CVPVPYLTLMPTPGGGDCCPTLQM-QKRRLGCCQGEEEDV HPVYPAP (SEQ ID NO: 275) in AA161187_P14 (SEQ ID NO:1321).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA161187_P14 (SEQ ID NO:1321) also has the following non-silent SNPs (Single Nucleotide Polymorphisms) as listed in Table 416, (given according to their position(s) on the amino acid sequence, with the alternative amino acid(s) listed; the last column indicates whether the SNP is known or not; the presence of known SNPs in variant protein AA161187_P14 (SEQ ID NO:1321) sequence provides support for the deduced sequence of this variant protein according to the present invention).

TABLE 416

Amino acid mutations

| SNP position(s) on amino acid sequence | Alternative amino acid(s) | Previously known SNP? |
|---|---|---|
| 1 | M -> | No |
| 16 | A -> | No |
| 238 | Q -> | No |

The glycosylation sites of variant protein AA161187_P14 (SEQ ID NO:1321), as compared to the known protein Testisin precursor (SEQ ID NO:1431), are described in Table 417 (given according to their position(s) on the amino acid sequence in the first column; the second column indicates whether the glycosylation site is present in the variant protein; and the last column indicates whether the position is different on the variant protein).

TABLE 417

Glycosylation site(s)

| Position(s) on known amino acid sequence | Present in variant protein? | Position in variant protein? |
|---|---|---|
| 200 | no | |
| 167 | yes | 167 |
| 273 | no | |

Variant protein AA161187_P14 (SEQ ID NO:1321) is encoded by the following transcript(s): AA161187_T16 (SEQ ID NO:44), for which the sequence(s) is/are given at the the application. The coding portion of transcript AA161187_T16 (SEQ ID NO:44) is shown in bold; this coding portion starts at position 107 and ends at position 1027. The transcript also has the following SNPs as listed in Table 418 (given according to their position on the nucleotide sequence, with the alternative nucleic acid listed; the last column indicates whether the SNP is known or not; the presence of known SNPs in variant protein AA161187_P14 (SEQ ID NO:1321) sequence provides support for the deduced sequence of this variant protein according to the present invention).

TABLE 418

Nucleic acid SNPs

| SNP position on nucleotide sequence | Alternative nucleic acid | Previously known SNP? |
|---|---|---|
| 66 | T -> A | No |
| 67 | T -> G | No |
| 105 | C -> T | No |
| 108 | T -> | No |
| 154 | T -> | No |

TABLE 418-continued

Nucleic acid SNPs

| SNP position on nucleotide sequence | Alternative nucleic acid | Previously known SNP? |
|---|---|---|
| 190 | C -> G | No |
| 469 | A -> G | Yes |
| 571 | C -> T | Yes |
| 819 | A -> | No |
| 859 | C -> T | Yes |
| 1152 | T -> C | Yes |
| 1156 | A -> G | No |
| 1162 | G -> A | No |
| 1190 | G -> | No |
| 1190 | G -> A | Yes |
| 1190 | G -> C | No |
| 1293 | A -> G | Yes |
| 1361 | G -> | No |
| 1361 | G -> A | No |
| 1362 | C -> A | No |
| 1461 | A -> G | Yes |

Variant protein AA161187_P18 (SEQ ID NO:1322) according to the present invention has an amino acid sequence as given at the end of the application; it is encoded by transcript(s) AA161187_T20 (SEQ ID NO:45). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison Report Between AA161187_P18 (SEQ ID NO:1322) and TEST_HUMAN (SEQ ID NO:1431):

1. An isolated chimeric polypeptide encoding for AA161187_P18 (SEQ ID NO:1322), comprising a first amino acid sequence being at least 70%, optionally at least 80%, preferably at least 85%, more preferably at least 90% and most preferably at least 95% homologous to a polypeptide having the sequence HTREGTLGGQKRAFPDGVEG-EKGRGRAWGAASRGSAVPLTIR (SEQ ID NO: 273) corresponding to amino acids 1-42 of AA161187_P18 (SEQ ID NO:1322), a second amino acid sequence being at least 90% homologous to GPCGRRVITSRIVGGEDAELGRWP-WQGSLRLWDSHVCGVSLLSHRWALTAAHCFET corresponding to amino acids 31-86 of TEST_HUMAN (SEQ ID NO:1431), which also corresponds to amino acids 43-98 of AA161187_P118 (SEQ ID NO:1322), a third amino acid sequence being at least 90% homologous to DLSDPSGWM-VQFGQLTSMPSFWSLQAYYTRYFVS-
NIYLSPRYLGNSPYDIALVKLSAPV TYTKHIQPI-CLQASTFEFENRTDCWVTGWGYIKEDEALPSPHTL QEVQVAIINNSMCNH LFLKYSFRKDIFGDMVCAG-NAQGGKDACF corresponding to amino acids 89-235 of TEST_HUMAN (SEQ ID NO:1431), which also corresponds to amino acids 99-245 of AA161187_P18 (SEQ ID NO:1322), and a fourth amino acid sequence being at least 70%, optionally at least 80%, preferably at least 85%, more preferably at least 90% and most preferably at least 95% homologous to a polypeptide having the sequence VSVPAT-TPSPGKHPVSLCLI (SEQ ID NO: 277) corresponding to amino acids 246-265 of AA161187_P18 (SEQ ID NO:1322), wherein said first amino acid sequence, second amino acid sequence, third amino acid sequence and fourth amino acid sequence are contiguous and in a sequential order.

2. An isolated polypeptide encoding for a head of AA161187_P18 (SEQ ID NO:1322), comprising a polypeptide being at least 70%, optionally at least about 80%, preferably at least about 85%, more preferably at least about 90% and most preferably at least about 95% homologous to the sequence HTREGTLGGQKRAFPDGVEGEKGRGRAW-GAASRGSAVPLTIR (SEQ ID NO: 273) of AA161187_P18 (SEQ ID NO:1322).

3. An isolated chimeric polypeptide encoding for an edge portion of AA161187_P18 (SEQ ID NO:1322), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 98−x to 98; and ending at any of amino acid numbers 99+((n−2)−x), in which x varies from 0 to n−2.

4. An isolated polypeptide encoding for a tail of AA161187_P18 (SEQ ID NO:1322), comprising a polypeptide being at least 70%, optionally at least about 80%, preferably at least about 85%, more preferably at least about 90% and most preferably at least about 95% homologous to the sequence VSVPATTPSPGKHPVSLCLI (SEQ ID NO: 277) in AA161187_P18 (SEQ ID NO:1322).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein AA161187_P18 (SEQ ID NO:1322) also has the following non-silent SNPs (Single Nucleotide Polymorphisms) as listed in Table 419, (given according to their position(s) on the amino acid sequence, with the alternative amino acid(s) listed; the last column indicates whether the SNP is known or not; the presence of known SNPs in variant protein AA161187_P18 (SEQ ID NO:1322) sequence provides support for the deduced sequence of this variant protein according to the present invention).

TABLE 419

Amino acid mutations

| SNP position(s) on amino acid sequence | Alternative amino acid(s) | Previously known SNP? |
|---|---|---|
| 236 | N -> | No |
| 249 | P -> L | Yes |

The glycosylation sites of variant protein AA161187_P18 (SEQ ID NO:1322), as compared to the known protein Testisin precursor (SEQ ID NO:1431), are described in Table 420 (given according to their position(s) on the amino acid sequence in the first column; the second column indicates whether the glycosylation site is present in the variant protein; and the last column indicates whether the position is different on the variant protein).

TABLE 420

Glycosylation site(s)

| Position(s) on known amino acid sequence | Present in variant protein? | Position in variant protein? |
|---|---|---|
| 200 | yes | 210 |
| 167 | yes | 177 |
| 273 | no | |

Variant protein AA161187_P18 (SEQ ID NO:1322) is encoded by the following transcript(s): AA161187_T20 (SEQ ID NO:45), for which the sequence(s) is/are given at the end of the application. The coding portion of transcript AA161187_T20 (SEQ ID NO:45) is shown in bold; this coding portion starts at position 1 and ends at position 796. The transcript also has the following SNPs as listed in Table 421 (given according to their position on the nucleotide sequence, with the alternative nucleic acid listed; the last column indicates whether the SNP is known or not; the presence of known SNPs in variant protein AA 161187_P18 (SEQ ID NO:1322) sequence provides support for the deduced sequence of this variant protein according to the present invention).

TABLE 421

Nucleic acid SNPs

| SNP position on nucleotide sequence | Alternative nucleic acid | Previously known SNP? |
|---|---|---|
| 394 | A -> G | Yes |
| 496 | C -> T | Yes |
| 707 | A -> | No |
| 747 | C -> T | Yes |
| 1040 | T -> C | Yes |
| 1044 | A -> G | No |
| 1050 | G -> A | No |
| 1078 | G -> | No |
| 1078 | G -> A | Yes |
| 1078 | G -> C | No |
| 1181 | A -> G | Yes |
| 1249 | G -> | No |
| 1249 | G -> A | No |
| 1250 | C -> A | No |
| 1349 | A -> G | Yes |

Variant protein AA161187_P19 (SEQ ID NO:1323) according to the present invention has an amino acid sequence as given at the end of the application; it is encoded by transcript(s) AA161187_T21 (SEQ ID NO:46). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison Report Between AA161187_P19 (SEQ ID NO:1323) and TEST_HUMAN (SEQ ID NO:1431):

1. An isolated chimeric polypeptide encoding for AA161187_P19 (SEQ ID NO:1323), comprising a first amino acid sequence being at least 90% homologous to MGARGALLLALLLARAGLRKPESQEAA-PLSGPCGRRVITSRIVGGEDAELGRWPWQGS LRLWD-SHVCGVSLLSHRWALTAAHCFETYSDLS-DPSGWMVQFGQLTSMPSFWSLQAY YTRYFVSNIYLSPRYLGNSPYDIALVKL-SAPVTYTKHIQPICLQASTFEFENRTDCWVTG WGY- IKEDE corresponding to amino acids 1-183 of TEST_HU-MAN (SEQ ID NO:1431), which also corresponds to amino acids 1-183 of AA161187_P19 (SEQ ID NO:1323), and a second amino acid sequence being at least 70%, optionally at least 80%, preferably at least 85%, more preferably at least 90% and most preferably at least 95% homologous to a polypeptide having the sequence DKRTQ (SEQ ID NO: 278) corresponding to amino acids 184-188 of AA161187_P19 (SEQ ID NO:1323), wherein said first amino acid sequence and second amino acid sequence are contiguous and in a sequential order.

2. An isolated polypeptide encoding for a tail of AA161187_P19 (SEQ ID NO:1323), comprising a polypeptide being at least 70%, optionally at least about 80%, preferably at least about 85%, more preferably at least about 90% and most preferably at least about 95% homologous to the sequence DKRTQ (SEQ ID NO: 278) in AA161187_P19 (SEQ ID NO:1323).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA161187_P19 (SEQ ID NO:1323) also has the following non-silent SNPs (Single Nucleotide Polymorphisms) as listed in Table 422, (given according to their position(s) on the amino acid sequence, with the alternative amino acid(s) listed; the last column indicates whether the SNP is known or not; the presence of known SNPs in variant protein AA161187_P19 (SEQ ID NO:1323) sequence provides support for the deduced sequence of this variant protein according to the present invention).

TABLE 422

Amino acid mutations

| SNP position(s) on amino acid sequence | Alternative amino acid(s) | Previously known SNP? |
|---|---|---|
| 1 | M -> | No |
| 16 | A -> | No |

The glycosylation sites of variant protein AA161187_P19 (SEQ ID NO:1323), as compared to the known protein Testisin precursor (SEQ ID NO:1431), are described in Table 423 (given according to their position(s) on the amino acid sequence in the first column; the second column indicates whether the glycosylation site is present in the variant protein; and the last column indicates whether the position is different on the variant protein).

TABLE 423

Glycosylation site(s)

| Position(s) on known amino acid sequence | Present in variant protein? | Position in variant protein? |
|---|---|---|
| 200 | no | |
| 167 | yes | 167 |
| 273 | no | |

Variant protein AA161187_P19 (SEQ ID NO:1323) is encoded by the following transcript(s): AA161187_T21 (SEQ ID NO:46), for which the sequence(s) is/are given at the end of the application. The coding portion of transcript AA 161187_T21 (SEQ ID NO:46) is shown in bold; this coding portion starts at position 107 and ends at position 670. The transcript also has the following SNPs as listed in Table 424 (given according to their position on the nucleotide sequence, with the alternative nucleic acid listed; the last column indicates whether the SNP is known or not; the presence of known SNPs in variant protein AA161187_P19 (SEQ ID NO:1323) sequence provides support for the deduced sequence of this variant protein according to the present invention).

TABLE 424

Nucleic acid SNPs

| SNP position on nucleotide sequence | Alternative nucleic acid | Previously known SNP? |
|---|---|---|
| 66 | T -> A | No |
| 67 | T -> G | No |
| 105 | C -> T | No |
| 108 | T -> | No |
| 154 | T -> | No |
| 190 | C -> G | No |
| 469 | A -> G | Yes |
| 571 | C -> T | Yes |
| 719 | G -> T | Yes |

As noted above, cluster AA 161187 features 20 segment(s), which were listed in Table 404 above and for which the sequence(s) are given at the end of the application. These segment(s) are portions of nucleic acid sequence(s) which are described herein separately because they are of particular interest. A description of each segment according to the present invention is now provided.

Segment cluster AA161187_node_0 (SEQ ID NO:482) according to the present invention is supported by 21 libraries. The number of libraries was determined as previously described. This segment can be found in the following transcript(s): AA161187_T0 (SEQ ID NO:41), AA161187_T15 (SEQ ID NO:43), AA161187_T16 (SEQ ID NO:44), AA161187_T21 (SEQ ID NO:46) and AA161187_T22 (SEQ ID NO:47). Table 425 below describes the starting and ending position of this segment on each transcript.

TABLE 425

Segment location on transcripts

| Transcript name | Segment starting position | Segment ending position |
|---|---|---|
| AA161187_T0 (SEQ ID NO: 41) | 1 | 170 |
| AA161187_T15 (SEQ ID NO: 43) | 1 | 170 |
| AA161187_T16 (SEQ ID NO: 44) | 1 | 170 |
| AA161187_T21 (SEQ ID NO: 46) | 1 | 170 |
| AA161187_T22 (SEQ ID NO: 47) | 1 | 170 |

Segment cluster AA161187_node_6 (SEQ ID NO:483) according to the present invention is supported by 3 libraries. The number of libraries was determined as previously described. This segment can be found in the following transcript(s): AA161187_T7 (SEQ ID NO:42) and AA161187_T20 (SEQ ID NO:45). Table 426 below describes the starting and ending position of this segment on each transcript.

TABLE 426

Segment location on transcripts

| Transcript name | Segment starting position | Segment ending position |
|---|---|---|
| AA161187_T7 (SEQ ID NO: 42) | 1 | 120 |
| AA161187_T20 (SEQ ID NO: 45) | 1 | 120 |

Segment cluster AA161187_node_14 (SEQ ID NO:484) according to the present invention is supported by 35 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 427 below describes the starting and ending position of this segment on each transcript.

TABLE 427

Segment location on transcripts

| Transcript name | Segment starting position | Segment ending position |
|---|---|---|
| AA161187_T0 (SEQ ID NO: 41) | 446 | 656 |
| AA161187_T7 (SEQ ID NO: 42) | 377 | 587 |
| AA161187_T15 (SEQ ID NO: 43) | 446 | 656 |
| AA161187_T16 (SEQ ID NO: 44) | 446 | 656 |
| AA161187_T20 (SEQ ID NO: 45) | 371 | 581 |
| AA161187_T21 (SEQ ID NO: 46) | 446 | 656 |
| AA161187_T22 (SEQ ID NO: 47) | 446 | 656 |

Segment cluster AA161187_node_16 (SEQ ID NO:485) according to the present invention is supported by 2 libraries. The number of libraries was determined as previously described. This segment can be found in the following transcript(s): AA161187_T22 (SEQ ID NO:47). Table 428 below describes the starting and ending position of this segment on each transcript.

TABLE 428

Segment location on transcripts

| Transcript name | Segment starting position | Segment ending position |
|---|---|---|
| AA161187_T22 (SEQ ID NO: 47) | 657 | 953 |

Segment cluster AA161187_node_25 (SEQ ID NO:486) according to the present invention is supported by 13 libraries. The number of libraries was determined as previously described. This segment can be found in the following transcript(s): AA161187_T16 (SEQ ID NO:44) and AA161187_T20 (SEQ ID NO:45). Table 429 below describes the starting and ending position of this segment on each transcript.

TABLE 429

Segment location on transcripts

| Transcript name | Segment starting position | Segment ending position |
|---|---|---|
| AA161187_T16 (SEQ ID NO: 44) | 880 | 1104 |
| AA161187_T20 (SEQ ID NO: 45) | 768 | 992 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 430.

TABLE 430

Oligonucleotides related to this segment

| Oligonucleotide name | Overexpressed in cancers | Chip reference |
|---|---|---|
| AA161187_0_0_430 | lung malignant tumors | LUN |

Segment cluster AA161187_node_26 (SEQ ID NO:487) according to the present invention is supported by 39 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44) and AA161187_T20 (SEQ ID NO:45). Table 431 below describes the starting and ending position of this segment on each transcript.

TABLE 431

Segment location on transcripts

| Transcript name | Segment starting position | Segment ending position |
|---|---|---|
| AA161187_T0 (SEQ ID NO: 41) | 812 | 1173 |
| AA161187_T7 (SEQ ID NO: 42) | 743 | 1104 |
| AA161187_T15 (SEQ ID NO: 43) | 744 | 1105 |
| AA161187_T16 (SEQ ID NO: 44) | 1105 | 1466 |
| AA161187_T20 (SEQ ID NO: 45) | 993 | 1354 |

Segment cluster AA161187_node_28 (SEQ ID NO:488) according to the present invention is supported by 4 libraries. The number of libraries was determined as previously described. This segment can be found in the following transcript(s): AA161187_T21 (SEQ ID NO:46). Table 432 below describes the starting and ending position of this segment on each transcript.

TABLE 432

Segment location on transcripts

| Transcript name | Segment starting position | Segment ending position |
|---|---|---|
| AA161187_T21 (SEQ ID NO: 46) | 657 | 1171 |

According to an optional embodiment of the present invention, short segments related to the above cluster are also provided. These segments are up to about 120 bp in length, and so are included in a separate description.

Segment cluster AA161187_node_4 (SEQ ID NO:489) according to the present invention is supported by 22 libraries. The number of libraries was determined as previously described. This segment can be found in the following transcript(s): AA161187_T0 (SEQ ID NO:41), AA161187_T15 (SEQ ID NO:43), AA161187_T16 (SEQ ID NO:44), AA161187_T21 (SEQ ID NO:46) and AA161187_T22 (SEQ ID NO:47). Table 433 below describes the starting and ending position of this segment on each transcript.

TABLE 433

Segment location on transcripts

| Transcript name | Segment starting position | Segment ending position |
| --- | --- | --- |
| AA161187_T0 (SEQ ID NO: 41) | 171 | 197 |
| AA161187_T15 (SEQ ID NO: 43) | 171 | 197 |
| AA161187_T16 (SEQ ID NO: 44) | 171 | 197 |
| AA161187_T21 (SEQ ID NO: 46) | 171 | 197 |
| AA161187_T22 (SEQ ID NO: 47) | 171 | 197 |

Segment cluster AA161187_node_7 (SEQ ID NO:490) according to the present invention can be found in the following transcript(s): AA161187 T7 (SEQ ID NO:42) and AA161187_T20 (SEQ ID NO:45). Table 434 below describes the starting and ending position of this segment on each transcript.

TABLE 434

Segment location on transcripts

| Transcript name | Segment starting position | Segment ending position |
| --- | --- | --- |
| AA161187_T7 (SEQ ID NO: 42) | 121 | 128 |
| AA161187_T20 (SEQ ID NO: 45) | 121 | 128 |

Segment cluster AA161187_node_8 (SEQ ID NO:491) according to the present invention is supported by 23 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 435 below describes the starting and ending position of this segment on each transcript.

TABLE 435

Segment location on transcripts

| Transcript name | Segment starting position | Segment ending position |
| --- | --- | --- |
| AA161187_T0 (SEQ ID NO: 41) | 198 | 256 |
| AA161187_T7 (SEQ ID NO: 42) | 129 | 187 |
| AA161187_T15 (SEQ ID NO: 43) | 198 | 256 |
| AA161187_T16 (SEQ ID NO: 44) | 198 | 256 |
| AA161187_T20 (SEQ ID NO: 45) | 129 | 187 |
| AA161187_T21 (SEQ ID NO: 46) | 198 | 256 |
| AA161187_T22 (SEQ ID NO: 47) | 198 | 256 |

Segment cluster AA161187_node_9 (SEQ ID NO:492) according to the present invention is supported by 24 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 436 below describes the starting and ending position of this segment on each transcript.

TABLE 436

Segment location on transcripts

| Transcript name | Segment starting position | Segment ending position |
| --- | --- | --- |
| AA161187_T0 (SEQ ID NO: 41) | 257 | 298 |
| AA161187_T7 (SEQ ID NO: 42) | 188 | 229 |
| AA161187_T15 (SEQ ID NO: 43) | 257 | 298 |
| AA161187_T16 (SEQ ID NO: 44) | 257 | 298 |
| AA161187_T20 (SEQ ID NO: 45) | 188 | 229 |
| AA161187_T21 (SEQ ID NO: 46) | 257 | 298 |
| AA161187_T22 (SEQ ID NO: 47) | 257 | 298 |

Segment cluster AA161187_node_10 (SEQ ID NO:493) according to the present invention is supported by 25 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 437 below describes the starting and ending position of this segment on each transcript.

TABLE 437

Segment location on transcripts

| Transcript name | Segment starting position | Segment ending position |
| --- | --- | --- |
| AA161187_T0 (SEQ ID NO: 41) | 299 | 363 |
| AA161187_T7 (SEQ ID NO: 42) | 230 | 294 |
| AA161187_T15 (SEQ ID NO: 43) | 299 | 363 |
| AA161187_T16 (SEQ ID NO: 44) | 299 | 363 |
| AA161187_T20 (SEQ ID NO: 45) | 230 | 294 |
| AA161187_T21 (SEQ ID NO: 46) | 299 | 363 |
| AA161187_T22 (SEQ ID NO: 47) | 299 | 363 |

Segment cluster AA161187_node_12 (SEQ ID NO:494) according to the present invention can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T21 (SEQ ID NO:46) and AA161187_T22 (SEQ ID NO:47). Table 438 below describes the starting and ending position of this segment on each transcript.

TABLE 438

Segment location on transcripts

| Transcript name | Segment starting position | Segment ending position |
| --- | --- | --- |
| AA161187_T0 (SEQ ID NO: 41) | 364 | 369 |
| AA161187_T7 (SEQ ID NO: 42) | 295 | 300 |
| AA161187_T15 (SEQ ID NO: 43) | 364 | 369 |
| AA161187_T16 (SEQ ID NO: 44) | 364 | 369 |
| AA161187_T21 (SEQ ID NO: 46) | 364 | 369 |
| AA161187_T22 (SEQ ID NO: 47) | 364 | 369 |

Segment cluster AA161187_node_13 (SEQ ID NO:495) according to the present invention is supported by 25 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 439 below describes the starting and ending position of this segment on each transcript.

TABLE 439

Segment location on transcripts

| Transcript name | Segment starting position | Segment ending position |
|---|---|---|
| AA161187_T0 (SEQ ID NO: 41) | 370 | 445 |
| AA161187_T7 (SEQ ID NO: 42) | 301 | 376 |
| AA161187_T15 (SEQ ID NO: 43) | 370 | 445 |
| AA161187_T16 (SEQ ID NO: 44) | 370 | 445 |
| AA161187_T20 (SEQ ID NO: 45) | 295 | 370 |
| AA161187_T21 (SEQ ID NO: 46) | 370 | 445 |
| AA161187_T22 (SEQ ID NO: 47) | 370 | 445 |

Segment cluster AA161187_node_19 (SEQ ID NO:496) according to the present invention is supported by 4 libraries. The number of libraries was determined as previously described. This segment can be found in the following transcript(s): AA161187_T16 (SEQ ID NO:44). Table 440 below describes the starting and ending position of this segment on each transcript.

TABLE 440

Segment location on transcripts

| Transcript name | Segment starting position | Segment ending position |
|---|---|---|
| AA161187_T16 (SEQ ID NO: 44) | 657 | 693 |

Segment cluster AA161187_node_20 (SEQ ID NO:497) according to the present invention is supported by 28 libraries. The number of libraries was determined as previously described. This segment can be found in the following transcript(s): AA161187_T0 (SEQ ID NO:41), AA161187_T7 (SEQ ID NO:42), AA161187_T16 (SEQ ID NO:44) and AA161187_T20 (SEQ ID NO:45). Table 441 below describes the starting and ending position of this segment on each transcript.

TABLE 441

Segment location on transcripts

| Transcript name | Segment starting position | Segment ending position |
|---|---|---|
| AA161187_T0 (SEQ ID NO: 41) | 657 | 682 |
| AA161187_T7 (SEQ ID NO: 42) | 588 | 613 |
| AA161187_T16 (SEQ ID NO: 44) | 694 | 719 |
| AA161187_T20 (SEQ ID NO: 45) | 582 | 607 |

Segment cluster AA161187_node_21 (SEQ ID NO:498) according to the present invention is supported by 31 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44) and AA161187_T20 (SEQ ID NO:45). Table 442 below describes the starting and ending position of this segment on each transcript.

TABLE 442

Segment location on transcripts

| Transcript name | Segment starting position | Segment ending position |
|---|---|---|
| AA161187_T0 (SEQ ID NO: 41) | 683 | 741 |
| AA161187_T7 (SEQ ID NO: 42) | 614 | 672 |
| AA161187_T15 (SEQ ID NO: 43) | 657 | 715 |
| AA161187_T16 (SEQ ID NO: 44) | 720 | 778 |
| AA161187_T20 (SEQ ID NO: 45) | 608 | 666 |

Segment cluster AA161187_node_22 (SEQ ID NO:499) according to the present invention is supported by 34 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44) and AA161187_T20 (SEQ ID NO:45). Table 443 below describes the starting and ending position of this segment on each transcript.

TABLE 443

Segment location on transcripts

| Transcript name | Segment starting position | Segment ending position |
|---|---|---|
| AA161187_T0 (SEQ ID NO: 41) | 742 | 769 |
| AA161187_T7 (SEQ ID NO: 42) | 673 | 700 |
| AA161187_T15 (SEQ ID NO: 43) | 716 | 743 |
| AA161187_T16 (SEQ ID NO: 44) | 779 | 806 |
| AA161187_T20 (SEQ ID NO: 45) | 667 | 694 |

Segment cluster AA161187_node_23 (SEQ ID NO:500) according to the present invention is supported by 31 libraries. The number of libraries was determined as previously described. This segment can be found in the following transcript(s): AA161187_T0 (SEQ ID NO:41), AA161187_T7 (SEQ ID NO:42), AA161187_T16 (SEQ ID NO:44) and AA161187_T20 (SEQ ID NO:45). Table 444 below describes the starting and ending position of this segment on each transcript.

TABLE 444

Segment location on transcripts

| Transcript name | Segment starting position | Segment ending position |
|---|---|---|
| AA161187_T0 (SEQ ID NO: 41) | 770 | 811 |
| AA161187_T7 (SEQ ID NO: 42) | 701 | 742 |
| AA161187_T16 (SEQ ID NO: 44) | 807 | 848 |
| AA161187_T20 (SEQ ID NO: 45) | 695 | 736 |

Segment cluster AA161187_node__24 (SEQ ID NO:501) according to the present invention is supported by 12 libraries. The number of libraries was determined as previously described. This segment can be found in the following transcript(s): AA161187_T16 (SEQ ID NO:44) and AA161187_T20 (SEQ ID NO:45). Table 445 below describes the starting and ending position of this segment on each transcript.

TABLE 445

Segment location on transcripts

| Transcript name | Segment starting position | Segment ending position |
|---|---|---|
| AA161187_T16 (SEQ ID NO: 44) | 849 | 879 |
| AA161187_T20 (SEQ ID NO: 45) | 737 | 767 |

Variant Protein Alignment to the Previously Known Protein:

Sequence name: TEST_HUMAN (SEQ ID NO:1431)

Sequence documentation:

Alignment of: AA161187_P6 (SEQ ID NO:1319) x TEST_HUMAN (SEQ ID NO:1431) ..

Alignment segment 1/1:

| | | | |
|---|---|---|---|
| Quality: | 2894.00 | | |
| Escore: | 0 | | |
| Matching length: | 284 | Total length: | 284 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 43  GPCGRRVITSRIVGGEDAELGRWPWQGSLRLWDSHVCGVSLLSHRWALTA   92
     ||||||||||||||||||||||||||||||||||||||||||||||||||
 31  GPCGRRVITSRIVGGEDAELGRWPWQGSLRLWDSHVCGVSLLSHRWALTA   80

93  AHCFETYSDLSDPSGWMVQFGQLTSMPSFWSLQAYYTRYFVSNIYLSPRY  142
     |||||||||||||||||||||||||||||||||||||||||||||||||
 81  AHCFETYSDLSDPSGWMVQFGQLTSMPSFWSLQAYYTRYFVSNIYLSPRY  130

143  LGNSPYDIALVKLSAPVTYTKHIQPICLQASTFEFENRTDCWVTGWGYIK  192
     |||||||||||||||||||||||||||||||||||||||||||||||||
131  LGNSPYDIALVKLSAPVTYTKHIQPICLQASTFEFENRTDCWVTGWGYIK  180

193  EDEALPSPHTLQEVQVAIINNSMCNHLFLKYSFRKDIFGDMVCAGNAQGG  242
     |||||||||||||||||||||||||||||||||||||||||||||||||
181  EDEALPSPHTLQEVQVAIINNSMCNHLFLKYSFRKDIFGDMVCAGNAQGG  230

243  KDACFGDSGGPLACNKNGLWYQIGVVSWGVGCGRPNRPGVYTNISHHFEW  292
     |||||||||||||||||||||||||||||||||||||||||||||||||
231  KDACFGDSGGPLACNKNGLWYQIGVVSWGVGCGRPNRPGVYTNISHHFEW  280

293  IQKLMAQSGMSQPDPSWPLLFFPLLWALPLLGPV                 326
     |||||||||||||||||||||||||||||||||
281  IQKLMAQSGMSQPDPSWPLLFFPLLWALPLLGPV                 314
```

Sequence name: TEST_HUMAN (SEQ ID NO:1431)

Sequence documentation:

Alignment of: AA161187_P13 (SEQ ID NO:1320) x TEST_HUMAN (SEQ ID NO:1431) ..

Alignment segment 1/1:

| | | |
|---|---|---|
| Quality: | 1829.00 | |
| Escore: | 0 | |
| Matching length: | 183 | Total length: 183 |
| Matching Percent | 100.00 | Matching Percent Identity: 100.00 |
| Similarity: | | |
| Total Percent Similarity: | 100.00 | Total Percent Identity: 100.00 |
| Gaps: | 0 | |

Alignment:

```
  1   MGARGALLLALLLARAGLRKPESQEAAPLSGPCGRRVITSRIVGGEDAEL   50
      ||||||||||||||||||||||||||||||||||||||||||||||||||
  1   MGARGALLLALLLARAGLRKPESQEAAPLSGPCGRRVITSRIVGGEDAEL   50

51   GRWPWQGSLRLWDSHVCGVSLLSHRWALTAAHCFETYSDLSDPSGWMVQF   100
      ||||||||||||||||||||||||||||||||||||||||||||||||||
 51   GRWPWQGSLRLWDSHVCGVSLLSHRWALTAAHCFETYSDLSDPSGWMVQF   100

101   GQLTSMPSFWSLQAYYTRYFVSNIYLSPRYLGNSPYDIALVKLSAPVTYT   150
      ||||||||||||||||||||||||||||||||||||||||||||||||||
101   GQLTSMPSFWSLQAYYTRYFVSNIYLSPRYLGNSPYDIALVKLSAPVTYT   150

151   KHIQPICLQASTFEFENRTDCWVTGWGYIKEDE   183
      ||||||||||||||||||||||||||||||||
151   KHIQPICLQASTFEFENRTDCWVTGWGYIKEDE   183
```

Sequence name: TEST_HUMAN (SEQ ID NO:1431)

Sequence documentation:

Alignment of: AA161187_P14 (SEQ ID NO:1321) x TEST_HUMAN (SEQ ID NO:1431) ..

Alignment segment 1/1:

| | | |
|---|---|---|
| Quality: | 1829.00 | |
| Escore: | 0 | |
| Matching length: | 183 | Total length: 183 |
| Matching Percent | 100.00 | Matching Percent Identity: 100.00 |
| Similarity: | | |
| Total Percent Similarity: | 100.00 | Total Percent Identity: 100.00 |
| Gaps: | 0 | |

Alignment:

```
  1   MGARGALLLALLLARAGLRKPESQEAAPLSGPCGRRVITSRIVGGEDAEL   50
      ||||||||||||||||||||||||||||||||||||||||||||||||||
  1   MGARGALLLALLLARAGLRKPESQEAAPLSGPCGRRVITSRIVGGEDAEL   50

51   GRWPWQGSLRLWDSHVCGVSLLSHRWALTAAHCFETYSDLSDPSGWMVQF   100
      ||||||||||||||||||||||||||||||||||||||||||||||||||
 51   GRWPWQGSLRLWDSHVCGVSLLSHRWALTAAHCFETYSDLSDPSGWMVQF   100
```

```
101  GQLTSMPSFWSLQAYYTRYFVSNIYLSPRYLGNSPYDIALVKLSAPVTYT   150
     ||||||||||||||||||||||||||||||||||||||||||||||||||
101  GQLTSMPSFWSLQAYYTRYFVSNIYLSPRYLGNSPYDIALVKLSAPVTYT   150

151  KHIQPICLQASTFEFENRTDCWVTGWGYIKEDE                    183
     ||||||||||||||||||||||||||||||||
151  KHIQPICLQASTFEFENRTDCWVTGWGYIKEDE                    183
```

Sequence name: TEST_HUMAN (SEQ ID NO:1431)
Sequence documentation:
Alignment of: AA161187_P18 (SEQ ID NO:1322) x TEST_HUMAN (SEQ ID NO:1431)..
Alignment segment 1/1:

| | | | |
|---|---|---|---|
| Quality: | 1957.00 | | |
| Escore: | 0 | | |
| Matching length: | 203 | Total length: | 205 |
| Matching Percent Similarity: | 100.00 | Matching Percent Identity: | 100.00 |
| Total Percent Similarity: | 99.02 | Total Percent Identity: | 99.02 |
| Gaps: | 1 | | |

Alignment of: AA161187_P19 (SEQ ID NO:1323) x TEST_HUMAN (SEQ ID NO:1431)..
Alignment segment 1/1:

| | | | |
|---|---|---|---|
| Quality: | 1829.00 | Escore: | 0 |
| Matching length: | 183 | Total length: | 183 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
43   GPCGRRVITSRIVGGEDAELGRWPWQGSLRLWDSHVCGVSLLSHRWALTA    92
     |||||||||||||||||||||||||||||||||||||||||||||||||
31   GPCGRRVITSRIVGGEDAELGRWPWQGSLRLWDSHVCGVSLLSHRWALTA    80

93   AHCFET..DLSDPSGWMVQFGQLTSMPSFWSLQAYYTRYFVSNIYLSPRY   140
     ||||||  |||||||||||||||||||||||||||||||||||||||||
81   AHCFETYSDLSDPSGWMVQFGQLTSMPSFWSLQAYYTRYFVSNIYLSPRY   130

141  LGNSPYDIALVKLSAPVTYTKHIQPICLQASTFEFENRTDCWVTGWGYIK   190
     |||||||||||||||||||||||||||||||||||||||||||||||||
131  LGNSPYDIALVKLSAPVTYTKHIQPICLQASTFEFENRTDCWVTGWGYIK   180

191  EDEALPSPHTLQEVQVAIINNSMCNHLFLKYSFRKDIFGDMVCAGNAQGG   240
     |||||||||||||||||||||||||||||||||||||||||||||||||
181  EDEALPSPHTLQEVQVAIINNSMCNHLFLKYSFRKDIFGDMVCAGNAQGG   230

241  KDACF   245
     |||||
231  KDACF   235
```

Sequence name: TEST_HUMAN (SEQ ID NO:1431)
Sequence documentation:

Alignment:

```
1    MGARGALLLALLLARAGLRKPESQEAAPLSGPCGRRVITSRIVGGEDAEL    50
     |||||||||||||||||||||||||||||||||||||||||||||||||
1    MGARGALLLALLLARAGLRKPESQEAAPLSGPCGRRVITSRIVGGEDAEL    50

51   GRWPWQGSLRLWDSHVCGVSLLSHRWALTAAHCFETYSDLSDPSGWMVQF   100
     |||||||||||||||||||||||||||||||||||||||||||||||||
51   GRWPWQGSLRLWDSHVCGVSLLSHRWALTAAHCFETYSDLSDPSGWMVQF   100

101  GQLTSMPSFWSLQAYYTRYFVSNIYLSPRYLGNSPYDIALVKLSAPVTYT   150
     |||||||||||||||||||||||||||||||||||||||||||||||||
101  GQLTSMPSFWSLQAYYTRYFVSNIYLSPRYLGNSPYDIALVKLSAPVTYT   150

151  KHIQPICLQASTFEFENRTDCWVTGWGYIKEDE                    183
     ||||||||||||||||||||||||||||||||
151  KHIQPICLQASTFEFENRTDCWVTGWGYIKEDE                    183
```

Expression of *Homo sapiens* Protease, Serine, 21 (Testisin) (PRSS21) AA161187 Transcripts which are Detectable by Amplicon as Depicted in Sequence Name AA161187 Seg25 (SEQ ID NO:1654) in Normal and Cancerous Lung Tissues Expression of *Homo sapiens* protease, serine, 21 (testisin) (PRSS21) transcripts detectable by or according to seg25, AA161187 seg25 amplicon (SEQ ID NO:1654) and primers AA161187 seg17F2 (SEQ ID NO:1652) and AA161187 seg17R2 (SEQ ID NO:1653) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 64:
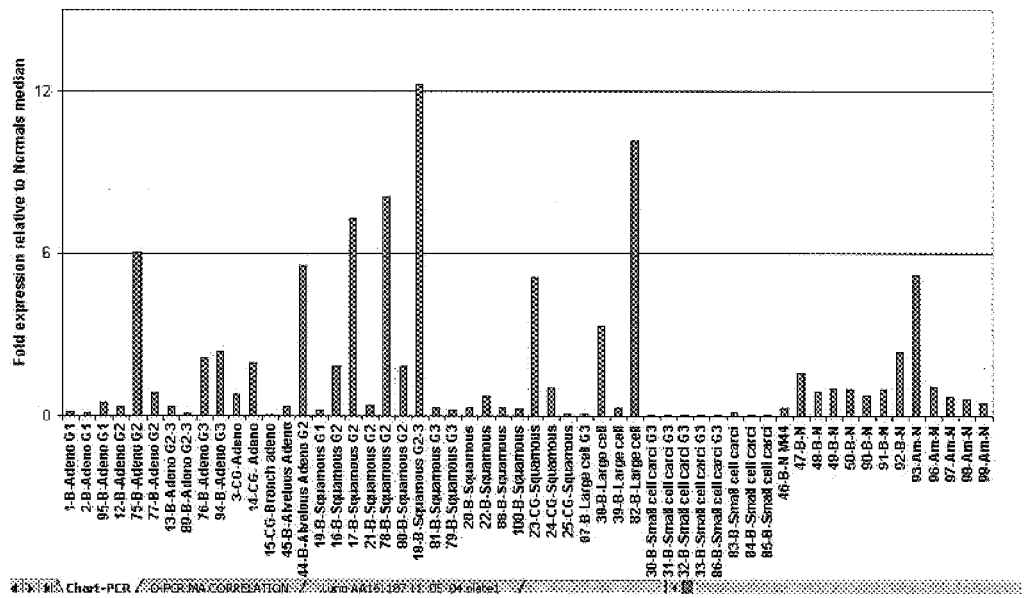
FIG. 64 is a histogram showing over expression of the *Homo sapiens* protease, serine, 21 (testisin) (PRSS21) AA161187 transcripts, which are detectable by amplicon as depicted in sequence name AA161187 seg25 (SEQ ID NO:1654), in cancerous lung samples relative to the normal samples.

FIG. 64 is a histogram showing over expression of the above-indicated *Homo sapiens* protease, serine, 21 (testisin) (PRSS21) transcripts in cancerous lung samples relative to the normal samples.

As is evident from FIG. 64, the expression of *Homo sapiens* protease, serine, 21 (testisin) (PRSS21) transcripts detectable by the above amplicon(s) was higher in a few cancer samples than in the non-cancerous samples (Sample Nos. 46-50, 90-93, 96-99 Table 2). Notably an over-expression of at least 6 fold was found in 1 out of 15 adenocarcinoma samples, 3 out of 16 squamous cell carcinoma samples, 1 out of 4 large cell carcinoma samples.

Primer pairs are also optionally and preferably encompassed within the present invention; for example, for the above experiment, the following primer pair was used as a non-limiting illustrative example only of a suitable primer pair: AA161187 seg17F2 forward primer (SEQ ID NO:1652); and AA161187 seg17R2 reverse primer (SEQ ID NO:1653).

The present invention also preferably encompasses any amplicon obtained through the use of any suitable primer pair; for example, for the above experiment, the following amplicon was obtained as a non-limiting illustrative example only of a suitable amplicon: AA161187 seg25 (SEQ ID NO:1654).

```
Forward primer AA161187 seg17F2
                                  (SEQ ID NO:1652)
CCCTGTGCCTTATTTGACCCT:

Reverse primer AA161187 seg17R2
                                  (SEQ ID NO:1653)
GCTGGGTAGACTGGGTGCA:

Amplicon AA161187 seg25
                                  (SEQ ID NO:1654)
CCTGTGCCTTATTTGACCCTCATGCCAACCCCGGGAGGTGGAGACTGTTG
CCCCACTCTGCAGATGCAGAAACGGAGGCTTGGCTGCTGCCAGG
GGGAGGA:
```

Description for Cluster R66178

Cluster R66178 features 3 transcript(s) and 16 segment(s) of interest, the names for which are given in Tables 446 and 447, respectively, the sequences themselves are given at the end of the application. The selected protein variants are given in table 448.

TABLE 446

Transcripts of interest

| Transcript Name | Sequence ID No. |
|---|---|
| R66178_T2 | 48 |
| R66178_T3 | 49 |
| R66178_T7 | 50 |

TABLE 447

Segments of interest

| Segment Name | Sequence ID No. |
|---|---|
| R66178_node_0 | 502 |
| R66178_node_6 | 503 |
| R66178_node_8 | 504 |
| R66178_node_15 | 505 |
| R66178_node_24 | 506 |
| R66178_node_26 | 507 |
| R66178_node_27 | 508 |
| R66178_node_4 | 509 |
| R66178_node_5 | 510 |
| R66178_node_9 | 511 |
| R66178_node_11 | 512 |
| R66178_node_16 | 513 |
| R66178_node_18 | 514 |
| R66178_node_19 | 515 |
| R66178_node_20 | 516 |
| R66178_node_21 | 517 |

TABLE 448

Proteins of interest

| Protein Name | Sequence ID No. | Corresponding Transcript(s) |
|---|---|---|
| R66178_P3 | 1324 | R66178_T2 (SEQ ID NO: 48) |
| R66178_P4 | 1325 | R66178_T3 (SEQ ID NO: 49) |
| R66178_P8 | 1326 | R66178_T7 (SEQ ID NO: 50) |

These sequences are variants of the known protein Poliovirus receptor related protein 1 precursor (SwissProt accession identifier PVR1_HUMAN; known also according to the synonyms Herpes virus entry mediator C; HveC; Nectin 1; Herpesvirus Ig-like receptor; HIgR; CD111 antigen), SEQ ID NO:1432, referred to herein as the previously known protein.

Protein Poliovirus receptor related protein 1 precursor (SEQ ID NO:1432) is known or believed to have the following function(s): probably involved in cell adhesion; receptor for alphaherpesvirus (HSV-1, HSV-2 and Pseudorabies virus) entry into cells. The sequence for protein Poliovirus receptor related protein 1 precursor is given at the end of the application, as "Poliovirus receptor related protein 1 precursor amino acid sequence". Protein Poliovirus receptor related protein 1 precursor localization is believed to be Type I membrane protein (isoforms alpha and delta). Secreted (isoform gamma).

The following GO Annotation(s) apply to the previously known protein. The following annotation(s) were found: immune response; cell-cell adhesion, which are annotation(s) related to Biological Process; cell adhesion receptor; protein binding; coreceptor, which are annotation(s) related to Molecular Function; and adherens junction; integral membrane protein, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

As noted above, cluster R66178 features 3 transcript(s), which were listed in Table 1 above. These transcript(s) encode for protein(s) which are variant(s) of protein Poliovirus receptor related protein 1 precursor (SEQ ID NO:1432). A description of each variant protein according to the present invention is now provided.

Variant protein R66178_P3 (SEQ ID NO:1324) according to the present invention has an amino acid sequence as given at the end of the application; it is encoded by transcript(s) R66178_T2 (SEQ ID NO:48). An alignment is given to the known protein (Poliovirus receptor related protein 1 precursor (SEQ ID NO:1432)) at the end of the application. One or more alignments to one or more previously published protein sequences are given at the end of the application. A brief description of the relationship of the variant protein according to the present invention to each such aligned protein is as follows:

Comparison Report Between R66178_P3 (SEQ ID NO:1324) and PVR1_HUMAN (SEQ ID NO:1432):

1. An isolated chimeric polypeptide encoding for R66178_P3 (SEQ ID NO:1324), comprising a first amino acid sequence being at least 90% homologous to MARMGLAGAAGRWWGLALGL-TAFFLPGVHSQVVQVNDSMYGFIGTDVVLHCSFANP LPSVKITQVTWQKSTNGSKQN-VAIYNPSMGVSVLAPYRERVEFLRPS-FTDGTIRLSRLEL EDEGVYICEFATFPTGNRESQLN-LTVMAKPTNWIEGTQAVLRAKKGQDDKVLVATCTS ANGKPPSVVSWETRLKGEAEYQEIRNP-NGTVTVISRYRLVPSREAHQQSLACIVNYHM DRFKESLTLNVQYEPEVTIEGFDGNW-YLQRMDVKLTCKADANPPATEYHWTTLNGSLP KGVEAQNRTLFFKGPINYSLAG-TYICEATNPIGTRSGQVEVNIT corresponding to amino acids 1-334 of PVR1_HUMAN (SEQ ID NO:1432), which also corresponds to amino acids 1-334 of R66178_P3 (SEQ ID NO:1324), and a second amino acid sequence being at least 70%, optionally at least 80%, preferably at least 85%, more preferably at least 90% and most preferably at least 95% homologous to a polypeptide having the sequence GEGH-SLPISPGVLQTQNCGP (SEQ ID NO: 694) corresponding to amino acids 335-354 of R66178_P3 (SEQ ID NO:1324), wherein said first amino acid sequence and second amino acid sequence are contiguous and in a sequential order.

2. An isolated polypeptide encoding for a tail of R66178_P3 (SEQ ID NO:1324), comprising a polypeptide being at least 70%, optionally at least about 80%, preferably at least about 85%, more preferably at least about 90% and most preferably at least about 95% homologous to the sequence GEGHSLPISPGVLQTQNCGP (SEQ ID NO: 694) in R66178_P3 (SEQ ID NO:1324).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R66178_P3 (SEQ ID NO:1324) also has the following non-silent SNPs (Single Nucleotide Polymorphisms) as listed in Table 449, (given according to their position(s) on the amino acid sequence, with the alternative amino acid(s) listed; the last column indicates whether the SNP is known or not; the presence of known SNPs in variant protein R66178_P3 (SEQ ID NO:1324) sequence provides support for the deduced sequence of this variant protein according to the present invention).

TABLE 449

Amino acid mutations

| SNP position(s) on amino acid sequence | Alternative amino acid(s) | Previously known SNP? |
|---|---|---|
| 77 | N -> S | No |

The glycosylation sites of variant protein R66178_P3 (SEQ ID NO:1324), as compared to the known protein Poliovirus receptor related protein 1 precursor (SEQ ID NO:1432), are described in Table 450 (given according to their position(s) on the amino acid sequence in the first column; the second column indicates whether the glycosylation site is present in the variant protein; and the last column indicates whether the position is different on the variant protein).

TABLE 450

Glycosylation site(s)

| Position(s) on known amino acid sequence | Present in variant protein? | Position in variant protein? |
|---|---|---|
| 72 | yes | 72 |
| 297 | yes | 297 |
| 202 | yes | 202 |
| 307 | yes | 307 |
| 332 | yes | 332 |
| 139 | yes | 139 |
| 36 | yes | 36 |
| 286 | yes | 286 |

Variant protein R66178_P3 (SEQ ID NO:1324) is encoded by the following transcript(s): R66178_T2 (SEQ ID NO:48), for which the sequence(s) is/are given at the end of the application. The coding portion of transcript R66178_T2 (SEQ ID NO:48) is shown in bold; this coding portion starts at position 634 and ends at position 1695. The transcript also has the following SNPs as listed in Table 451 (given according to their position on the nucleotide sequence, with the alternative nucleic acid listed; the last column indicates whether the SNP is known or not; the presence of known SNPs in variant protein R66178_P3 (SEQ ID NO:1324) sequence provides support for the deduced sequence of this variant protein according to the present invention).

TABLE 451

Nucleic acid SNPs

| SNP position on nucleotide sequence | Alternative nucleic acid | Previously known SNP? |
|---|---|---|
| 474 | -> T | No |
| 476 | -> C | No |
| 632 | -> T | No |
| 633 | G -> T | No |
| 863 | A -> G | No |
| 897 | C -> T | Yes |
| 2178 | A -> G | No |
| 2465 | G -> A | Yes |
| 2687 | G -> A | Yes |

Variant protein R66178_P4 (SEQ ID NO:1325) according to the present invention has an amino acid sequence as given at the end of the application; it is encoded by transcript(s) R66178_T3 (SEQ ID NO:49). An alignment is given to the known protein (Poliovirus receptor related protein 1 precursor (SEQ ID NO:1432)) at the end of the application. One or more alignments to one or more previously published protein sequences are given at the end of the application. A brief description of the relationship of the variant protein according to the present invention to each such aligned protein is as follows:

Comparison Report Between R66178_P4 (SEQ ID NO:1325) and PVR1_HUMAN (SEQ ID NO:1432):

1. An isolated chimeric polypeptide encoding for R66178_P4 (SEQ ID NO:1325), comprising a first amino acid sequence being at least 90% homologous to MARMGLAGAAGRWWGLALGL-TAFFLPGVHSQVVQVNDSMYGFIGTDVVLHCSFANP LPSVKITQVTWQKSTNGSKQN-VAIYNPSMGVSVLAPYRERVEFLRPS-FTDGTIRLSRLEL EDEGVYICEFATFPTGNRESQLN-LTVMAKPTNWIEGTQAVLRAKKGQDDKVLVATCTS ANGKPPSVVSWETRLKGEAEYQEIRNP-NGTVTVISRYRLVPSREAHQQSLACIVNYHM DRFKESLTLNVQYEPEVTIEGFDGNW-YLQRMDVKLTCKADANPPATEYHWTTLNGSLP KGVEAQNRTLFFKGPINYSLAG-TYICEATNPIGTRSGQVEVNIT corresponding to amino acids 1-334 of PVR1_HUMAN (SEQ ID NO:1432), which also corresponds to amino acids 1-334 of R66178_P4 (SEQ ID NO:1325), and a second amino acid sequence being at least 70%, optionally at least 80%, preferably at least 85%, more preferably at least 90% and most preferably at least 95% homologous to a polypeptide having the sequence AFC-QLIYPGKGRTRARMF (SEQ ID NO:1702) corresponding to amino acids 335-352 of R66178_P4 (SEQ ID NO:1325), wherein said first amino acid sequence and second amino acid sequence are contiguous and in a sequential order.

2. An isolated polypeptide encoding for a tail of R66178_P4 (SEQ ID NO:1325), comprising a polypeptide being at least 70%, optionally at least about 80%, preferably at least about 85%, more preferably at least about 90% and most preferably at least about 95% homologous to the sequence AFCQLIYPGKGRTRARMF (SEQ ID NO:1702) in R66178_P4 (SEQ ID NO:1325).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R66178_P4 (SEQ ID NO:1325) also has the following non-silent SNPs (Single Nucleotide Polymorphisms) as listed in Table 452, (given according to their position(s) on the amino acid sequence, with the alternative amino acid(s) listed; the last column indicates whether the SNP is known or not; the presence of known SNPs in variant protein R66178_P4 (SEQ ID NO:1325) sequence provides support for the deduced sequence of this variant protein according to the present invention).

TABLE 452

Amino acid mutations

| SNP position(s) on amino acid sequence | Alternative amino acid(s) | Previously known SNP? |
|---|---|---|
| 77 | N -> S | No |

The glycosylation sites of variant protein R66178_P4 (SEQ ID NO:1325), as compared to the known protein Poliovirus receptor related protein 1 precursor (SEQ ID NO:1432), are described in Table 453 (given according to their position(s) on the amino acid sequence in the first column; the second column indicates whether the glycosylation site is present in the variant protein; and the last column indicates whether the position is different on the variant protein).

TABLE 453

Glycosylation site(s)

| Position(s) on known amino acid sequence | Present in variant protein? | Position in variant protein? |
|---|---|---|
| 72 | yes | 72 |
| 297 | yes | 297 |
| 202 | yes | 202 |
| 307 | yes | 307 |
| 332 | yes | 332 |
| 139 | yes | 139 |
| 36 | yes | 36 |
| 286 | yes | 286 |

Variant protein R66178_P4 (SEQ ID NO:1325) is encoded by the following transcript(s): R66178_T3 (SEQ ID NO:49), for which the sequence(s) is/are given at the end of the application. The coding portion of transcript R66178_T3 (SEQ ID NO:49) is shown in bold; this coding portion starts at position 634 and ends at position 1689. The transcript also has the following SNPs as listed in Table 454 (given according to their position on the nucleotide sequence, with the alternative nucleic acid listed; the last column indicates whether the SNP is known or not; the presence of known SNPs in variant protein R66178_P4 (SEQ ID NO:1325) sequence provides support for the deduced sequence of this variant protein according to the present invention).

TABLE 454

Nucleic acid SNPs

| SNP position on nucleotide sequence | Alternative nucleic acid | Previously known SNP? |
|---|---|---|
| 474 | -> T | No |
| 476 | -> C | No |

TABLE 454-continued

Nucleic acid SNPs

| SNP position on nucleotide sequence | Alternative nucleic acid | Previously known SNP? |
|---|---|---|
| 632 | -> T | No |
| 633 | G -> T | No |
| 863 | A -> G | No |
| 897 | C -> T | Yes |
| 1762 | C -> | Yes |

Variant protein R66178_P8 (SEQ ID NO:1326) according to the present invention has an amino acid sequence as given at the end of the application; it is encoded by transcript(s) R66178_T7 (SEQ ID NO:50). An alignment is given to the known protein (Poliovirus receptor related protein 1 precursor (SEQ ID NO:1432)) at the end of the application. One or more alignments to one or more previously published protein sequences are given at the end of the application. A brief description of the relationship of the variant protein according to the present invention to each such aligned protein is as follows:

Comparison Report Between R66178_P8 (SEQ ID NO:1326) and PVR1_HUMAN (SEQ ID NO:1432):

1. An isolated chimeric polypeptide encoding for R66178_P8 (SEQ ID NO:1326), comprising a first amino acid sequence being at least 90% homologous to MARMGLAGAAGRWWGLALGL-TAFFLPGVHSQVVQVNDSMYGFIGTDVVLHCSFANP LPSVKITQVTWQKSTNGSKQN-VAIYNPSMGVSVLAPYRERVEFLRPS-FTDGTIRLSRLEL EDEGVYICEFATFPTGNRESQLN-LTVMAKPTNWIEGTQAVLRAKKGQDDKVLVATCTS ANGKPPSVVSWETRLKGEAEYQEIRNP-NGTVTVISRYRLVPSREAHQQSLACIVNYHM DRFKESLTLNVQYEPEVTIEGFDGNW-YLQRMDVKLTCKADANPPATEYHWTTLNGSLP KGVEAQNRTLFFKGPINYSLAG-TYICEATNPIGTRSGQVE corresponding to amino acids 1-330 of PVR1_HUMAN (SEQ ID NO:1432), which also corresponds to amino acids 1-330 of R66178_P8 (SEQ ID NO:1326), and a second amino acid sequence being at least 70%, optionally at least 80%, preferably at least 85%, more preferably at least 90% and most preferably at least 95% homologous to a polypeptide having the sequence NSPTPRLLPNMGGAPGRCPRPSLGAWRGASCWC (SEQ ID NO:1717) corresponding to amino acids 331-363 of R66178_P8 (SEQ ID NO:1326), wherein said first amino acid sequence and second amino acid sequence are contiguous and in a sequential order.

2. An isolated polypeptide encoding for a tail of R66178_P8 (SEQ ID NO:1326), comprising a polypeptide being at least 70%, optionally at least about 80%, preferably at least about 85%, more preferably at least about 90% and most preferably at least about 95% homologous to the sequence NSPTPRLLPNMGGAPGRCPRPSLGAWR-GASCWC (SEQ ID NO:1717) in R66178_P8 (SEQ ID NO:1326).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R66178_P8 (SEQ ID NO:1326) also has the following non-silent SNPs (Single Nucleotide Polymorphisms) as listed in Table 455, (given according to their position(s) on the amino acid sequence, with the alternative amino acid(s) listed; the last column indicates whether the SNP is known or not; the presence of known SNPs in variant protein R66178_P8 (SEQ ID NO:1326) sequence provides support for the deduced sequence of this variant protein according to the present invention).

TABLE 455

Amino acid mutations

| SNP position(s) on amino acid sequence | Alternative amino acid(s) | Previously known SNP? |
|---|---|---|
| 77 | N -> S | No |

The glycosylation sites of variant protein R66178_P8 (SEQ ID NO:1326), as compared to the known protein Poliovirus receptor related protein 1 precursor (SEQ ID NO:1432), are described in Table 456 (given according to their position(s) on the amino acid sequence in the first column; the second column indicates whether the glycosylation site is present in the variant protein; and the last column indicates whether the position is different on the variant protein).

TABLE 456

Glycosylation site(s)

| Position(s) on known amino acid sequence | Present in variant protein? | Position in variant protein? |
|---|---|---|
| 72 | yes | 72 |
| 297 | yes | 297 |
| 202 | yes | 202 |
| 307 | yes | 307 |
| 332 | no | |
| 139 | yes | 139 |
| 36 | yes | 36 |
| 286 | yes | 286 |

Variant protein R66178_P8 (SEQ ID NO:1326) is encoded by the following transcript(s): R66178_T7 (SEQ ID NO:50), for which the sequence(s) is/are given at the end of the application. The coding portion of transcript R66178_T7 (SEQ ID NO:50) is shown in bold; this coding portion starts at position 634 and ends at position 1722. The transcript also has the following SNPs as listed in Table 457 (given according to their position on the nucleotide sequence, with the alternative nucleic acid listed; the last column indicates whether the SNP is known or not; the presence of known SNPs in variant protein R66178_P8 (SEQ ID NO:1326) sequence provides support for the deduced sequence of this variant protein according to the invention).

TABLE 457

Nucleic acid SNPs

| SNP position on nucleotide sequence | Alternative nucleic acid | Previously known SNP? |
|---|---|---|
| 474 | -> T | No |
| 476 | -> C | No |
| 632 | -> T | No |

TABLE 457-continued

Nucleic acid SNPs

| SNP position on nucleotide sequence | Alternative nucleic acid | Previously known SNP? |
|---|---|---|
| 633 | G -> T | No |
| 863 | A -> G | No |
| 897 | C -> T | Yes |
| 2210 | A -> C | No |
| 2211 | A -> C | No |

As noted above, cluster R66178 features 16 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R66178_node_0 (SEQ ID NO:502) according to the present invention is supported by 19 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 458 below describes the starting and ending position of this segment on each transcript.

TABLE 458

Segment location on transcripts

| Transcript name | Segment starting position | Segment ending position |
|---|---|---|
| R66178_T2 (SEQ ID NO: 48) | 1 | 712 |
| R66178_T3 (SEQ ID NO: 49) | 1 | 712 |
| R66178_T7 (SEQ ID NO: 50) | 1 | 712 |

Segment cluster R66178_node_6 (SEQ ID NO:503) according to the present invention is supported by 39 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 459 below describes the starting and ending position of this segment on each transcript.

TABLE 459

Segment location on transcripts

| Transcript name | Segment starting position | Segment ending position |
|---|---|---|
| R66178_T2 (SEQ ID NO: 48) | 762 | 1063 |
| R66178_T3 (SEQ ID NO: 49) | 762 | 1063 |
| R66178_T7 (SEQ ID NO: 50) | 762 | 1063 |

Segment cluster R66178_node_8 (SEQ ID NO:504) according to the present invention is supported by 39 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 460 below describes the starting and ending position of this segment on each transcript.

TABLE 460

Segment location on transcripts

| Transcript name | Segment starting position | Segment ending position |
|---|---|---|
| R66178_T2 (SEQ ID NO: 48) | 1064 | 1269 |
| R66178_T3 (SEQ ID NO: 49) | 1064 | 1269 |
| R66178_T7 (SEQ ID NO: 50) | 1064 | 1269 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 461.

TABLE 461

Oligonucleotides related to this segment

| Oligonucleotide name | Overexpressed in cancers | Chip reference |
|---|---|---|
| R66178_0_7_0 | lung malignant tumors | LUN |

Segment cluster R66178_node_15 (SEQ ID NO:505) according to the present invention is supported by 40 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 462 below describes the starting and ending position of this segment on each transcript.

TABLE 462

Segment location on transcripts

| Transcript name | Segment starting position | Segment ending position |
|---|---|---|
| R66178_T2 (SEQ ID NO: 48) | 1485 | 1623 |
| R66178_T3 (SEQ ID NO: 49) | 1485 | 1623 |
| R66178_T7 (SEQ ID NO: 50) | 1485 | 1623 |

Segment cluster R66178_node_24 (SEQ ID NO:506) according to the present invention is supported by 10 libraries. The number of libraries was determined as previously described. This segment can be found in the following transcript(s): R66178_T2 (SEQ ID NO:48). Table 463 below describes the starting and ending position of this segment on each transcript.

TABLE 463

Segment location on transcripts

| Transcript name | Segment starting position | Segment ending position |
|---|---|---|
| R66178_T2 (SEQ ID NO: 48) | 1637 | 3110 |

Segment cluster R66178_node_26 (SEQ ID NO:507) according to the present invention is supported by 24 libraries. The number of libraries was determined as previously described. This segment can be found in the following transcript(s): R66178_T7 (SEQ ID NO:50). Table 464 below describes the starting and ending position of this segment on each transcript.

TABLE 464

Segment location on transcripts

| Transcript name | Segment starting position | Segment ending position |
|---|---|---|
| R66178_T7 (SEQ ID NO: 50) | 1624 | 2087 |

Segment cluster R66178_node_27 (SEQ ID NO:508) according to the present invention is supported by 12 libraries. The number of libraries was determined as previously described. This segment can be found in the following transcript(s): R66178_T7 (SEQ ID NO:50). Table 465 below describes the starting and ending position of this segment on each transcript.

TABLE 465

Segment location on transcripts

| Transcript name | Segment starting position | Segment ending position |
|---|---|---|
| R66178_T7 (SEQ ID NO: 50) | 2088 | 2364 |

According to an optional embodiment of the present invention, short segments related to the above cluster are also provided. These segments are up to about 120 bp in length, and so are included in a separate description.

Segment cluster R66178_node_4 (SEQ ID NO:509) according to the present invention is supported by 21 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 466 below describes the starting and ending position of this segment on each transcript.

TABLE 466

Segment location on transcripts

| Transcript name | Segment starting position | Segment ending position |
|---|---|---|
| R66178_T2 (SEQ ID NO: 48) | 713 | 749 |
| R66178_T3 (SEQ ID NO: 49) | 713 | 749 |
| R66178_T7 (SEQ ID NO: 50) | 713 | 749 |

Segment cluster R66178_node_5 (SEQ ID NO:510) according to the present invention can be found in the following transcript(s): R66178_T2 (SEQ ID NO:48), R66178_T3 (SEQ ID NO:49) and R66178_T7 (SEQ ID NO:50). Table 467 below describes the starting and ending position of this segment on each transcript.

TABLE 467

Segment location on transcripts

| Transcript name | Segment starting position | Segment ending position |
|---|---|---|
| R66178_T2 (SEQ ID NO: 48) | 750 | 761 |
| R66178_T3 (SEQ ID NO: 49) | 750 | 761 |
| R66178_T7 (SEQ ID NO: 50) | 750 | 761 |

Segment cluster R66178_node_9 (SEQ ID NO:511) according to the present invention is supported by 44 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 468 below describes the starting and ending position of this segment on each transcript.

TABLE 468

Segment location on transcripts

| Transcript name | Segment starting position | Segment ending position |
|---|---|---|
| R66178_T2 (SEQ ID NO: 48) | 1270 | 1366 |
| R66178_T3 (SEQ ID NO: 49) | 1270 | 1366 |
| R66178_T7 (SEQ ID NO: 50) | 1270 | 1366 |

Segment cluster R66178_node_11 (SEQ ID NO:512) according to the present invention is supported by 44 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 469 below describes the starting and ending position of this segment on each transcript.

TABLE 469

Segment location on transcripts

| Transcript name | Segment starting position | Segment ending position |
|---|---|---|
| R66178_T2 (SEQ ID NO: 48) | 1367 | 1484 |
| R66178_T3 (SEQ ID NO: 49) | 1367 | 1484 |
| R66178_T7 (SEQ ID NO: 50) | 1367 | 1484 |

Segment cluster R66178_node_16 (SEQ ID NO:513) according to the present invention can be found in the following transcript(s): R66178_T2 (SEQ ID NO:48) and R66178_T3 (SEQ ID NO:49). Table 470 below describes the starting and ending position of this segment on each transcript.

TABLE 470

Segment location on transcripts

| Transcript name | Segment starting position | Segment ending position |
|---|---|---|
| R66178_T2 (SEQ ID NO: 48) | 1624 | 1636 |
| R66178_T3 (SEQ ID NO: 49) | 1624 | 1636 |

Segment cluster R66178_node_18 (SEQ ID NO:514) according to the present invention is supported by 13 libraries. The number of libraries was determined as previously described. This segment can be found in the following transcript(s): R66178_T3 (SEQ ID NO:49). Table 471 below describes the starting and ending position of this segment on each transcript.

TABLE 471

Segment location on transcripts

| Transcript name | Segment starting position | Segment ending position |
|---|---|---|
| R66178_T3 (SEQ ID NO: 49) | 1637 | 1743 |

Segment cluster R66178_node__19 (SEQ ID NO:515) according to the present invention can be found in the following transcript(s): R66178_T3 (SEQ ID NO:49). Table 472 below describes the starting and ending position of this segment on each transcript.

TABLE 472

Segment location on transcripts

| Transcript name | Segment starting position | Segment ending position |
|---|---|---|
| R66178_T3 (SEQ ID NO: 49) | 1744 | 1763 |

Segment cluster R66178_node__20 (SEQ ID NO:516) according to the present invention is supported by 12 libraries. The number of libraries was determined as previously described. This segment can be found in the following transcript(s): R66178_T3 (SEQ ID NO:49). Table 473 below describes the starting and ending position of this segment on each transcript.

TABLE 473

Segment location on transcripts

| Transcript name | Segment starting position | Segment ending position |
|---|---|---|
| R66178_T3 (SEQ ID NO: 49) | 1764 | 1791 |

Segment cluster R66178_node__21 (SEQ ID NO:517) according to the present invention is supported by 11 libraries. The number of libraries was determined as previously described. This segment can be found in the following transcript(s): R66178_T3 (SEQ ID NO:49). Table 474 below describes the starting and ending position of this segment on each transcript.

TABLE 474

Segment location on transcripts

| Transcript name | Segment starting position | Segment ending position |
|---|---|---|
| R66178_T3 (SEQ ID NO: 49) | 1792 | 1903 |

Variant Protein Alignment to the Previously Known Protein:
Sequence name: PVR1_HUMAN (SEQ ID NO:1432)
Sequence documentation:
Alignment of: R66178_P3 (SEQ ID NO:1324) x PVR1_HUMAN (SEQ ID NO:1432) ..
Alignment segment 1/1:

| | | | |
|---|---|---|---|
| Quality: | 3286.00 | | |
| Escore: | 0 | | |
| Matching length: | 334 | Total length: | 334 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MARMGLAGAAGRWWGLALGLTAFFLPGVHSQVVQVNDSMYGFIGTDVVLH   50
     ||||||||||||||||||||||||||||||||||||||||||||||||||
  1  MARMGLAGAAGRWWGLALGLTAFFLPGVHSQVVQVNDSMYGFIGTDVVLH   50

51  CSFANPLPSVKITQVTWQKSTNGSKQNVAIYNPSMGVSVLAPYRERVEFL  100
     ||||||||||||||||||||||||||||||||||||||||||||||||||
 51  CSFANPLPSVKITQVTWQKSTNGSKQNVAIYNPSMGVSVLAPYRERVEFL  100

101  RPSFTDGTIRLSRLELEDEGVYICEFATFPTGNRESQLNLTVMAKPTNWI  150
     ||||||||||||||||||||||||||||||||||||||||||||||||||
101  RPSFTDGTIRLSRLELEDEGVYICEFATFPTGNRESQLNLTVMAKPTNWI  150

151  EGTQAVLRAKKGQDDKVLVATCTSANGKPPSVVSWETRLKGEAEYQEIRN  200
     ||||||||||||||||||||||||||||||||||||||||||||||||||
151  EGTQAVLRAKKGQDDKVLVATCTSANGKPPSVVSWETRLKGEAEYQEIRN  200

201  PNGTVTVISRYRLVPSREAHQQSLACIVNYHMDRFKESLTLNVQYEPEVT  250
     ||||||||||||||||||||||||||||||||||||||||||||||||||
201  PNGTVTVISRYRLVPSREAHQQSLACIVNYHMDRFKESLTLNVQYEPEVT  250

251  IEGFDGNWYLQRMDVKLTCKADANPPATEYHWTTLNGSLPKGVEAQNRTL  300
     ||||||||||||||||||||||||||||||||||||||||||||||||||
251  IEGFDGNWYLQRMDVKLTCKADANPPATEYHWTTLNGSLPKGVEAQNRTL  300

301  FFKGPINYSLAGTYICEATNPIGTRSGQVEVNIT                 334
     ||||||||||||||||||||||||||||||||||
301  FFKGPINYSLAGTYICEATNPIGTRSGQVEVNIT                 334
```

Sequence name: PVR1_HUMAN (SEQ ID NO:1432)
Sequence documentation:
Alignment of: R66178_P4 (SEQ ID NO:1325) x PVR1_HUMAN (SEQ ID NO:1432) ..
Alignment segment 1/1:

| | | | |
|---|---|---|---|
| Quality: | 3294.00 | | |
| Escore: | 0 | | |
| Matching length: | 336 | Total length: | 336 |
| Matching Percent Similarity: | 99.70 | Matching Percent Identity: | 99.70 |
| Total Percent Similarity: | 99.70 | Total Percent Identity: | 99.70 |
| Gaps: | 0 | | |

Alignment:

```
  1  MARMGLAGAAGRWWGLALGLTAFFLPGVHSQVVQVNDSMYGFIGTDVVLH   50
     ||||||||||||||||||||||||||||||||||||||||||||||||||
  1  MARMGLAGAAGRWWGLALGLTAFFLPGVHSQVVQVNDSMYGFIGTDVVLH   50

51  CSFANPLPSVKITQVTWQKSTNGSKQNVAIYNPSMGVSVLAPYRERVEFL  100
     |||||||||||||||||||||||||||||||||||||||||||||||||
 51  CSFANPLPSVKITQVTWQKSTNGSKQNVAIYNPSMGVSVLAPYRERVEFL  100

101  RPSFTDGTIRLSRLELEDEGVYICEFATFPTGNRESQLNLTVMAKPTNWI  150
     |||||||||||||||||||||||||||||||||||||||||||||||||
101  RPSFTDGTIRLSRLELEDEGVYICEFATFPTGNRESQLNLTVMAKPTNWI  150

151  EGTQAVLRAKKGQDDKVLVATCTSANGKPPSVVSWETRLKGEAEYQEIRN  200
     |||||||||||||||||||||||||||||||||||||||||||||||||
151  EGTQAVLRAKKGQDDKVLVATCTSANGKPPSVVSWETRLKGEAEYQEIRN  200

201  PNGTVTVISRYRLVPSREAHQQSLACIVNYHMDRFKESLTLNVQYEPEVT  250
     |||||||||||||||||||||||||||||||||||||||||||||||||
201  PNGTVTVISRYRLVPSREAHQQSLACIVNYHMDRFKESLTLNVQYEPEVT  250

251  IEGFDGNWYLQRMDVKLTCKADANPPATEYHWTTLNGSLPKGVEAQNRTL  300
     |||||||||||||||||||||||||||||||||||||||||||||||||
251  IEGFDGNWYLQRMDVKLTCKADANPPATEYHWTTLNGSLPKGVEAQNRTL  300

301  FFKGPINYSLAGTYICEATNPIGTRSGQVEVNITAF  336
     |||||||||||||||||||||||||||||||||| |
301  FFKGPINYSLAGTYICEATNPIGTRSGQVEVNITEF  336
```

Sequence name: PVR1_HUMAN (SEQ ID NO:1432)
Sequence documentation:
Alignment of: R66178_P8 (SEQ ID NO:1326) x PVR1_HUMAN (SEQ ID NO:1432) ..
Alignment segment 1/1:

| | | | |
|---|---|---|---|
| Quality: | 3250.00 | | |
| Escore: | 0 | | |
| Matching length: | 330 | Total length: | 330 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MARMGLAGAAGRWWGLALGLTAFFLPGVHSQVVQVNDSMYGFIGTDVVLH   50
     ||||||||||||||||||||||||||||||||||||||||||||||||||
  1  MARMGLAGAAGRWWGLALGLTAFFLPGVHSQVVQVNDSMYGFIGTDVVLH   50

51  CSFANPLPSVKITQVTWQKSTNGSKQNVAIYNPSMGVSVLAPYRERVEFL  100
     |||||||||||||||||||||||||||||||||||||||||||||||||
 51  CSFANPLPSVKITQVTWQKSTNGSKQNVAIYNPSMGVSVLAPYRERVEFL  100

101  RPSFTDGTIRLSRLELEDEGVYICEFATFPTGNRESQLNLTVMAKPTNWI  150
     |||||||||||||||||||||||||||||||||||||||||||||||||
101  RPSFTDGTIRLSRLELEDEGVYICEFATFPTGNRESQLNLTVMAKPTNWI  150

151  EGTQAVLRAKKGQDDKVLVATCTSANGKPPSVVSWETRLKGEAEYQEIRN  200
     |||||||||||||||||||||||||||||||||||||||||||||||||
151  EGTQAVLRAKKGQDDKVLVATCTSANGKPPSVVSWETRLKGEAEYQEIRN  200

201  PNGTVTVISRYRLVPSREAHQQSLACIVNYHMDRFKESLTLNVQYEPEVT  250
     |||||||||||||||||||||||||||||||||||||||||||||||||
201  PNGTVTVISRYRLVPSREAHQQSLACIVNYHMDRFKESLTLNVQYEPEVT  250

251  IEGFDGNWYLQRMDVKLTCKADANPPATEYHWTTLNGSLPKGVEAQNRTL  300
     |||||||||||||||||||||||||||||||||||||||||||||||||
251  IEGFDGNWYLQRMDVKLTCKADANPPATEYHWTTLNGSLPKGVEAQNRTL  300

301  FFKGPINYSLAGTYICEATNPIGTRSGQVE  330
     |||||||||||||||||||||||||||||
301  FFKGPINYSLAGTYICEATNPIGTRSGQVE  330
```

Description for Cluster HUMPHOSLIP

Cluster HUMPHOSLIP features 7 transcript(s) and 53 segment(s) of interest, the names for which are given in Tables 475 and 476, respectively, the sequences themselves are given at the end of the application. The selected protein variants are given in table 477.

TABLE 475

Transcripts of interest

| Transcript Name | Sequence ID No. |
| --- | --- |
| HUMPHOSLIP_PEA_2_T6 | 51 |
| HUMPHOSLIP_PEA_2_T7 | 52 |
| HUMPHOSLIP_PEA_2_T14 | 53 |
| HUMPHOSLIP_PEA_2_T16 | 54 |
| HUMPHOSLIP_PEA_2_T17 | 55 |
| HUMPHOSLIP_PEA_2_T18 | 56 |
| HUMPHOSLIP_PEA_2_T19 | 57 |

TABLE 476

Segments of interest

| Segment Name | Sequence ID No. |
| --- | --- |
| HUMPHOSLIP_PEA_2_node_0 | 518 |
| HUMPHOSLIP_PEA_2_node_19 | 519 |
| HUMPHOSLIP_PEA_2_node_34 | 520 |
| HUMPHOSLIP_PEA_2_node_68 | 521 |
| HUMPHOSLIP_PEA_2_node_70 | 522 |
| HUMPHOSLIP_PEA_2_node_75 | 523 |
| HUMPHOSLIP_PEA_2_node_2 | 524 |
| HUMPHOSLIP_PEA_2_node_3 | 525 |
| HUMPHOSLIP_PEA_2_node_4 | 526 |
| HUMPHOSLIP_PEA_2_node_6 | 527 |

TABLE 476-continued

Segments of interest

| Segment Name | Sequence ID No. |
| --- | --- |
| HUMPHOSLIP_PEA_2_node_7 | 528 |
| HUMPHOSLIP_PEA_2_node_8 | 529 |
| HUMPHOSLIP_PEA_2_node_9 | 530 |
| HUMPHOSLIP_PEA_2_node_14 | 531 |
| HUMPHOSLIP_PEA_2_node_15 | 532 |
| HUMPHOSLIP_PEA_2_node_16 | 533 |
| HUMPHOSLIP_PEA_2_node_17 | 534 |
| HUMPHOSLIP_PEA_2_node_23 | 535 |
| HUMPHOSLIP_PEA_2_node_24 | 536 |
| HUMPHOSLIP_PEA_2_node_25 | 537 |
| HUMPHOSLIP_PEA_2_node_26 | 538 |
| HUMPHOSLIP_PEA_2_node_29 | 539 |
| HUMPHOSLIP_PEA_2_node_30 | 540 |
| HUMPHOSLIP_PEA_2_node_33 | 541 |
| HUMPHOSLIP_PEA_2_node_36 | 542 |
| HUMPHOSLIP_PEA_2_node_37 | 543 |
| HUMPHOSLIP_PEA_2_node_39 | 544 |
| HUMPHOSLIP_PEA_2_node_40 | 545 |
| HUMPHOSLIP_PEA_2_node_41 | 546 |
| HUMPHOSLIP_PEA_2_node_42 | 547 |
| HUMPHOSLIP_PEA_2_node_44 | 548 |
| HUMPHOSLIP_PEA_2_node_45 | 549 |
| HUMPHOSLIP_PEA_2_node_47 | 550 |
| HUMPHOSLIP_PEA_2_node_51 | 551 |
| HUMPHOSLIP_PEA_2_node_52 | 552 |
| HUMPHOSLIP_PEA_2_node_53 | 553 |
| HUMPHOSLIP_PEA_2_node_54 | 554 |
| HUMPHOSLIP_PEA_2_node_55 | 555 |
| HUMPHOSLIP_PEA_2_node_58 | 556 |
| HUMPHOSLIP_PEA_2_node_59 | 557 |
| HUMPHOSLIP_PEA_2_node_60 | 558 |
| HUMPHOSLIP_PEA_2_node_61 | 559 |
| HUMPHOSLIP_PEA_2_node_62 | 560 |
| HUMPHOSLIP_PEA_2_node_63 | 562 |
| HUMPHOSLIP_PEA_2_node_64 | 562 |
| HUMPHOSLIP_PEA_2_node_65 | 563 |
| HUMPHOSLIP_PEA_2_node_66 | 564 |
| HUMPHOSLIP_PEA_2_node_67 | 565 |
| HUMPHOSLIP_PEA_2_node_69 | 566 |
| HUMPHOSLIP_PEA_2_node_71 | 567 |
| HUMPHOSLIP_PEA_2_node_72 | 568 |
| HUMPHOSLIP_PEA_2_node_73 | 569 |
| HUMPHOSLIP_PEA_2_node_74 | 570 |

TABLE 477

Proteins of interest

| Protein Name | Sequence ID No. | Corresponding Transcript(s) |
| --- | --- | --- |
| HUMPHOSLIP_PEA_2_P10 | 1327 | HUMPHOSLIP_PEA_2_T17 (SEQ ID NO: 55) |
| HUMPHOSLIP_PEA_2_P12 | 1328 | HUMPHOSLIP_PEA_2_T19 (SEQ ID NO: 57) |
| HUMPHOSLIP_PEA_2_P30 | 1329 | HUMPHOSLIP_PEA_2_T6 (SEQ ID NO: 51) |
| HUMPHOSLIP_PEA_2_P31 | 1330 | HUMPHOSLIP_PEA_2_T7 (SEQ ID NO: 52) |
| HUMPHOSLIP_PEA_2_P33 | 1331 | HUMPHOSLIP_PEA_2_T14 (SEQ ID NO: 53) |
| HUMPHOSLIP_PEA_2_P34 | 1332 | HUMPHOSLIP_PEA_2_T16 (SEQ ID NO: 54) |
| HUMPHOSLIP_PEA_2_P35 | 1333 | HUMPHOSLIP_PEA_2_T18 (SEQ ID NO: 56) |

These sequences are variants of the known protein Phospholipid transfer protein precursor (SwissProt accession identifier PLTP_HUMAN; known also according to the synonyms Lipid transfer protein II), SEQ ID NO:1433, referred to herein as the previously known protein.

Protein Phospholipid transfer protein precursor (SEQ ID NO:1433) is known or believed to have the following function(s): Converts HDL into larger and smaller particles. May play a key role in extracellular phospholipid transport and modulation of HDL particles. The sequence for protein Phospholipid transfer protein precursor is given at the end of the application, as "Phospholipid transfer protein precursor amino acid sequence". Known polymorphisms for this sequence are as shown in Table 478.

TABLE 478

Amino acid mutations for Known Protein

| SNP position(s) on amino acid sequence | Comment |
|---|---|
| 282 | R -> Q./FTId = VAR__017020. |
| 372 | R -> H./FTId = VAR__017021. |
| 380 | R -> W (in dbSNP: 6065903)./FTId = VAR__017022. |
| 444 | F -> L (in dbSNP: 1804161)./FTId = VAR__012073. |
| 487 | T -> K (in dbSNP: 1056929)./FTId = VAR__012074. |
| 18 | E -> V |

Protein Phospholipid transfer protein precursor (SEQ ID NO:1433) localization is believed to be Secreted.

The following GO Annotation(s) apply to the previously known protein. The following annotation(s) were found: lipid metabolism; lipid transport, which are annotation(s) related to Biological Process; lipid binding, which are annotation(s) related to Molecular Function; and extracellular, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 479, with regard to lung cancer.

TABLE 479

Oligonucleotides related to this cluster

| Oligonucleotide name | Overexpressed in cancers | Chip reference |
|---|---|---|
| HUMPHOSLIP_0_0_18458 | lung malignant tumors | LUN |

As noted above, cluster HUMPHOSLIP features 7 transcript(s), which were listed in Table 1 above. These transcript(s) encode for protein(s) which are variant(s) of protein Phospholipid transfer protein precursor (SEQ ID NO:1433). A description of each variant protein according to the present invention is now provided.

Variant protein HUMPHOSLIP_PEA_2_P10 (SEQ ID NO:1327) according to the present invention has an amino acid sequence as given at the end of the application; it is encoded by transcript(s) HUMPHOSLIP_PEA_2_T17 (SEQ ID NO:55). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison Report Between HUMPHOSLIP_PEA_2_P10 (SEQ ID NO:1327) and PLTP_HUMAN (SEQ ID NO:1433):

1. An isolated chimeric polypeptide encoding for HUMPHOSLIP_PEA_2_P10 (SEQ ID NO:1327), comprising a first amino acid sequence being at least 90% homologous to MALFGALFLALLAGAHAEFPGCK-IRVTSKALELVKQEGLRFLEQELETITIPDLRGKEGH FYYNISE corresponding to amino acids 1-67 of PLTP_HUMAN (SEQ ID NO:1433), which also corresponds to amino acids 1-67 of HUMPHOSLIP_PEA_2_P10 (SEQ ID NO:1327), and a second amino acid sequence being at least 90% homologous to KVYDFLSTFITSGMRFLLNQ-QICPVLYHAGTVLLNSLLDTVPVRSS-VDELVGIDYSLMK DPVASTSNLDMDFRGAFF-PLTERNWSLPNRAVEPQLQEEERMVYVAFSEFFFDS AMES YFRAGALQLLLVGDKVPHDLDMLLRATY-FGSIVLLSPAVIDSPLKLELRVLAPPRCTIKP SGTTIS-VTASVTIALVPPDQPEVQLSSMTMDARL-SAKMALRGKALRTQLDLRRFRIYSN HSALESLALIPLQAPLKTMLQIGVMPML-NERTWRGVQIPLPEGINFVHEVVTNHAGFLTI GADL-HFAKGLREVIEKNRPADVRASTAPTPSTAAV corresponding to amino acids 163-493 of PLTP_HUMAN (SEQ ID NO:1433), which also corresponds to amino acids 68-398 of HUMPHOSLIP_PEA_2_P10 (SEQ ID NO:1327), wherein said first amino acid sequence and second amino acid sequence are contiguous and in a sequential order.

2. An isolated chimeric polypeptide encoding for an edge portion of HUMPHOSLIP_PEA_2_P10 (SEQ ID NO:1327), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EK, having a structure as follows: a sequence starting from any of amino acid numbers 67−x to 67; and ending at any of amino acid numbers 68+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P10 (SEQ ID NO:1327) also has the following no-silent SNPs (Single Nucleotide Polymorphisms) as listed in Table 480, (given according to their position(s) on the amino acid sequence, with the alternative amino acid(s) listed; the last column indicates whether the SNP is known or not; the presence of known SNPs in variant protein HUMPHOSLIP_PEA_2_P10 (SEQ ID NO:1327) sequence provides support for the deduced sequence of this variant protein according to the present invention).

TABLE 480

Amino acid mutations

| SNP position(s) on amino acid sequence | Alternative amino acid(s) | Previously known SNP? |
|---|---|---|
| 16 | H -> R | Yes |
| 18 | E -> V | Yes |
| 113 | S -> F | Yes |
| 118 | V -> | No |
| 140 | R -> | No |
| 140 | R -> P | No |
| 150 | N -> | No |
| 160 | P -> | No |
| 201 | P -> | No |
| 274 | M -> | No |
| 285 | R -> W | Yes |
| 292 | Q -> | No |
| 315 | L -> * | No |
| 330 | M -> I | Yes |
| 349 | F -> L | Yes |
| 392 | T -> K | Yes |

The glycosylation sites of variant protein HUMPHOSLIP_PEA_2_P10 (SEQ ID NO:1327), as compared to the known protein Phospholipid transfer protein precursor (SEQ ID NO:1433), are described in Table 481 (given according to their position(s) on the amino acid sequence in the first column; the second column indicates whether the glycosylation site is present in the variant protein; and the last column indicates whether the position is different on the variant protein).

TABLE 481

Glycosylation site(s)

| Position(s) on known amino acid sequence | Present in variant protein? | Position in variant protein? |
|---|---|---|
| 94 | no | |
| 143 | no | |
| 64 | yes | 64 |
| 245 | yes | 150 |
| 398 | yes | 303 |
| 117 | no | |

Variant protein HUMPHOSLIP_PEA_2_P10 (SEQ ID NO:1327) is encoded by the following transcript(s): HUMPHOSLIP_PEA_2_T17 (SEQ ID NO:55), for which the sequence(s) is/are given at the end of the application. The coding portion of transcript HUMPHOSLIP_PEA_2_T17 (SEQ ID NO:55) is shown in bold; this coding portion starts at position 276 and ends at position 1469. The transcript also has the following SNPs as listed in Table 482 (given according to their position on the nucleotide sequence, with the alternative nucleic acid listed; the last column indicates whether the SNP is known or not; the presence of known SNPs in variant protein HUMPHOSLIP_PEA_2_P10 (SEQ ID NO:1327) sequence provides support for the deduced sequence of this variant protein according to the present invention).

TABLE 482

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 551 | C -> T | Yes |
| 613 | C -> T | Yes |
| 628 | T -> | No |
| 694 | G -> | No |
| 694 | G -> C | No |
| 723 | A -> | No |
| 753 | C -> | No |
| 876 | C -> | No |
| 1037 | C -> T | Yes |
| 1097 | G -> | No |
| 1128 | C -> T | Yes |
| 1149 | C -> | No |
| 1219 | T -> A | No |
| 1230 | C -> T | Yes |
| 1265 | G -> C | Yes |
| 1322 | T -> A | Yes |
| 1450 | C -> A | Yes |
| 1469 | C -> T | No |
| 1549 | C -> T | Yes |
| 1565 | A -> G | No |
| 1565 | A -> T | No |
| 1630 | A -> G | Yes |
| 1654 | T -> A | No |
| 1731 | G -> T | Yes |
| 1864 | G -> A | Yes |
| 1893 | G -> T | Yes |
| 2073 | G -> A | Yes |
| 2269 | C -> T | Yes |
| 2325 | G -> T | Yes |
| 2465 | C -> T | Yes |
| 2566 | C -> T | Yes |
| 2881 | A -> G | No |

Variant protein HUMPHOSLIP_PEA_2_P12 (SEQ ID NO:1328) according to the present invention has an amino acid sequence as given at the end of the application; it is encoded by transcript(s) HUMPHOSLIP_PEA_2_T19 (SEQ ID NO:57). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison Report Between HUMPHOSLIP_PEA_2_P12 (SEQ ID NO:1328) and PLTP_HUMAN (SEQ ID NO:1433):

1. An isolated chimeric polypeptide encoding for HUMPHOSLIP_PEA_2_P12 (SEQ ID 28), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQICPVLYHAGTVLLNSLL-DTVPVRSSVDELVGIDYSLMKDPVASTSNLDMDFRG AFFPLTERNWSLPNRAVEPQLQEEERM-VYVAFSEFFFDSAMESYFRAGALQLLLVGDK VPH-DLDMLLRATYFGSIVLLSPAVID-SPLKLELRVLAPPRCTIKPSGTTISVTASVTIALVP PDQPEVQLSSMTMDARLSAKMALRGKAL-RTQLDLRRFRIYSNHSALESLALIPLQAPLK TML-QIGVMPMLN corresponding to amino acids 1-427 of PLTP_HUMAN (SEQ ID NO:1433), which also corresponds to amino acids 1-427 of HUMPHOSLIP_PEA__2_P12 (SEQ ID NO:1328), and a second amino acid sequence being at least 70%, optionally at least 80%, preferably at least 85%, more preferably at least 90% and most preferably at least 95% homologous to a polypeptide having the sequence GKAGV (SEQ ID NO: 263) corresponding to amino acids 428-432 of HUMPHOSLIP_PEA__2_P12 (SEQ ID NO:1328), wherein said first amino acid sequence and second amino acid sequence are contiguous and in a sequential order.

2. An isolated polypeptide encoding for a tail of HUMPHOSLIP_PEA__2_P12 (SEQ ID NO:1328), comprising a polypeptide being at least 70%, optionally at least about 80%, preferably at least about 85%, more preferably at least about 90% and most preferably at least about 95% homologous to the sequence GKAGV (SEQ ID NO: 263) in HUMPHOSLIP_ PEA__2_P12 (SEQ ID NO:1328).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA__2_P12 (SEQ ID NO:1328) also has the following non-silent SNPs (Single Nucleotide Polymorphisms) as listed in Table 483, (given according to their position(s) on the amino acid sequence, with the alternative amino acid(s) listed; the last column indicates whether the SNP is known or not; the presence of known SNPs in variant protein HUMPHOSLIP_PEA__2_P12 (SEQ ID NO:1328) sequence provides support for the deduced sequence of this variant protein according to the present invention).

TABLE 483

Amino acid mutations

| SNP position(s) on amino acid sequence | Alternative amino acid(s) | Previously known SNP? |
|---|---|---|
| 16 | H -> R | Yes |
| 18 | E -> V | Yes |
| 81 | D -> H | Yes |
| 124 | S -> Y | Yes |
| 160 | T -> | No |
| 160 | T -> N | No |
| 208 | S -> F | Yes |
| 213 | V -> | No |
| 235 | R -> P | No |
| 235 | R -> | No |
| 245 | N -> | No |
| 255 | P -> | No |
| 296 | P -> | No |
| 369 | M -> | No |
| 380 | R -> W | Yes |
| 387 | Q -> | No |
| 410 | L -> * | No |
| 425 | M -> I | Yes |

The glycosylation sites of variant protein HUMPHOSLIP_PEA__2_P12 (SEQ ID NO:1328), as compared to the known protein Phospholipid transfer protein precursor (SEQ ID NO:1433), are described in Table 484 (given according to their position(s) on the amino acid sequence in the first column; the second column indicates whether the glycosylation site is present in the variant protein; and the last column indicates whether the position is different on the variant protein).

TABLE 484

Glycosylation site(s)

| Position(s) on known amino acid sequence | Present in variant protein? | Position in variant protein? |
|---|---|---|
| 94 | yes | 94 |
| 143 | yes | 143 |
| 64 | yes | 64 |
| 245 | yes | 245 |
| 398 | yes | 398 |
| 117 | yes | 117 |

Variant protein HUMPHOSLIP_PEA__2_P12 (SEQ ID NO:1328) is encoded by the following transcript(s): HUMPHOSLIP_PEA__2_T19 (SEQ ID NO:57), for which the sequence(s) is/are given at the end of the application. The coding portion of transcript HUMPHOSLIP_PEA__2_T19 (SEQ ID NO:57) is shown in bold; this coding portion starts at position 276 and ends at position 1571. The transcript also has the following SNPs as listed in Table 485 (given according to their position on the nucleotide sequence, with the alternative nucleic acid listed; the last column indicates whether the SNP is known or not; the presence of known SNPs in variant protein HUMPHOSLIP_PEA__2_P12 (SEQ ID NO:1328) sequence provides support for the deduced sequence of this variant protein according to the present invention).

TABLE 485

Nucleic acid SNPs

| SNP position(s) on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 516 | G -> C | Yes |
| 644 | G -> A | Yes |
| 646 | C -> A | Yes |
| 754 | C -> | No |
| 754 | C -> A | No |
| 836 | C -> T | Yes |
| 898 | C -> T | Yes |
| 913 | T -> | No |
| 979 | G -> | No |
| 979 | G -> C | No |
| 1008 | A -> | No |
| 1038 | C -> | No |
| 1161 | C -> | No |
| 1322 | C -> T | Yes |
| 1382 | G -> | No |
| 1413 | C -> T | Yes |
| 1434 | C -> | No |
| 1504 | T -> A | No |
| 1515 | C -> T | Yes |
| 1550 | G -> C | Yes |
| 1690 | T -> A | Yes |
| 1818 | C -> A | Yes |
| 1837 | C -> T | No |
| 1917 | C -> T | Yes |
| 1933 | A -> G | No |
| 1933 | A -> T | No |
| 1998 | A -> G | Yes |

TABLE 485-continued

| | Nucleic acid SNPs | |
|---|---|---|
| SNP position(s) on nucleotide sequence | Alternative nucleic acid | Previously known SNP? |
| 2022 | T -> A | No |
| 2099 | G -> T | Yes |
| 2232 | G -> A | Yes |
| 2261 | G -> T | Yes |
| 2441 | G -> A | Yes |
| 2637 | C -> T | Yes |
| 2693 | G -> T | Yes |
| 2833 | C -> T | Yes |
| 2934 | C -> T | Yes |
| 3249 | A -> G | No |

Variant protein HUMPHOSLIP_PEA_2_P30 (SEQ ID NO:1329) according to the present invention has an amino acid sequence as given at the end of the application; it is encoded by transcript(s) HUMPHOSLIP_PEA_2_T6 (SEQ ID NO:51). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P30 (SEQ ID NO:1329) also has the following non-silent SNPs (Single Nucleotide Polymorphisms) as listed in Table 486, (given according to their position(s) on the amino acid sequence, with the alternative amino acid(s) listed; the last column indicates whether the SNP is known or not; the presence of known SNPs in variant protein HUMPHOSLIP_PEA_2_P30 (SEQ ID NO:1329) sequence provides support for the deduced sequence of this variant protein according to the present invention).

TABLE 486

| | Amino acid mutations | |
|---|---|---|
| SNP position(s) on amino acid sequence | Alternative amino acid(s) | Previously known SNP? |
| 16 | H -> R | Yes |
| 18 | E -> V | Yes |
| 37 | R -> Q | Yes |

Variant protein HUMPHOSLIP_PEA_2_P30 (SEQ ID NO:1329) is encoded by the following transcript(s): HUMPHOSLIP_PEA_2_T6 (SEQ ID NO:51), for which the sequence(s) is/are given at the end of the application. The coding portion of transcript HUMPHOSLIP_PEA_2_T6 (SEQ ID NO:51) is shown in bold; this coding portion starts at position 276 and ends at position 431. The transcript also has the following SNPs as listed in Table 487 (given according to their position on the nucleotide sequence, with the alternative nucleic acid listed; the last column indicates whether the SNP is known or not; the presence of known SNPs in variant protein HUMPHOSLIP_PEA_2_P30 (SEQ ID NO:1329) sequence provides support for the deduced sequence of this variant protein according to the present invention).

TABLE 487

| | Nucleic acid SNPs | |
|---|---|---|
| SNP position on nucleotide sequence | Alternative nucleic acid | Previously known SNP? |
| 174 | G -> T | No |
| 175 | A -> T | No |
| 322 | A -> G | Yes |
| 328 | A -> T | Yes |
| 385 | G -> A | Yes |
| 470 | G -> C | Yes |
| 598 | G -> A | Yes |
| 600 | C -> A | Yes |
| 708 | C -> | No |
| 708 | C -> A | No |
| 790 | C -> T | Yes |
| 852 | C -> T | Yes |
| 867 | T -> | No |
| 933 | G -> | No |
| 933 | G -> C | No |
| 962 | A -> | No |
| 992 | C -> | No |
| 1115 | C -> | No |
| 1276 | C -> T | Yes |
| 1336 | G -> | No |
| 1367 | C -> T | Yes |
| 1388 | C -> | No |
| 1458 | T -> A | No |
| 1469 | C -> T | Yes |
| 1504 | G -> C | Yes |
| 1561 | T -> A | Yes |
| 1689 | C -> A | Yes |
| 1708 | C -> T | No |
| 1788 | C -> T | Yes |
| 1804 | A -> G | No |
| 1804 | A -> T | No |
| 1869 | A -> G | Yes |
| 1893 | T -> A | No |
| 1970 | G -> T | Yes |
| 2103 | G -> A | Yes |
| 2132 | G -> T | Yes |
| 2312 | G -> A | Yes |
| 2508 | C -> T | Yes |
| 2564 | G -> T | Yes |
| 2704 | C -> T | Yes |
| 2805 | C -> T | Yes |
| 3120 | A -> G | No |

Variant protein HUMPHOSLIP_PEA_2_P31 (SEQ ID NO:1330) according to the present invention has an amino acid sequence as given at the end of the application; it is encoded by transcript(s) HUMPHOSLIP_PEA_2_T7 (SEQ ID NO:52). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison Report Between HUMPHOSLIP_PEA_2_P31 (SEQ ID NO:1330) and PLTP_HUMAN (SEQ ID NO:1433):

1. An isolated chimeric polypeptide encoding for HUMPHOSLIP_PEA_2_P31 (SEQ ID NO:1330), comprising a first amino acid sequence being at least 90% homologous to MALFGALFLALLAGAHAEFPGCK-IRVTSKALELVKQEGLRFLEQELETITIPDLRGKEGH FYYNISE corresponding to amino acids 1-67 of PLTP_HUMAN (SEQ ID NO:1433), which also corresponds to amino acids 1-67 of HUMPHOSLIP_PEA_2_P31 (SEQ ID NO:1330), and a second amino acid sequence being at least 70%, optionally at least 80%, preferably at least 85%, more preferably at least 90% and most preferably at least 95% homologous to a polypeptide having the sequence PGLER-GADKFPVVGGSSLFLALDLTLRPPVG (SEQ ID NO: 264) corresponding to amino acids 68-98 of HUMPHOSLIP_PEA_2_P31 (SEQ ID NO:1330), wherein said first amino acid sequence and second amino acid sequence are contiguous and in a sequential order.

2. An isolated polypeptide encoding for a tail of HUMPHOSLIP_PEA_2_P31 (SEQ ID NO:1330), comprising a polypeptide being at least 70%, optionally at least about 80%, preferably at least about 85%, more preferably at least about 90% and most preferably at least about 95% homologous to the sequence PGLERGADKFPVVGGSSLFLALDLTLRPPVG (SEQ ID NO: 264) in HUMPHOSLIP_PEA_2_P31 (SEQ ID NO:1330).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P31 (SEQ ID NO:1330) also has the following non-silent SNPs (Single Nucleotide Polymorphisms) as listed in Table 488, (given according to their position(s) on the amino acid sequence, with the alternative amino acid(s) listed; the last column indicates whether the SNP is known or not; the presence of known SNPs in variant protein HUMPHOSLIP_PEA_2_P31 (SEQ ID NO:1330) sequence provides support for the deduced sequence of this variant protein according to the present invention).

TABLE 488

Amino acid mutations

| SNP position(s) on amino acid sequence | Alternative amino acid(s) | Previously known SNP? |
|---|---|---|
| 16 | H -> R | Yes |
| 18 | E -> V | Yes |

The glycosylation sites of variant protein. HUMPHOSLIP_PEA_2_P31 (SEQ ID NO:1330), as compared to the known protein Phospholipid transfer protein precursor (SEQ ID NO:1433), are described in Table 489 (given according to their position(s) on the amino acid sequence in the first column; the second column indicates whether the glycosylation site is present in the variant protein; and the last column indicates whether the position is different on the variant protein).

TABLE 489

Glycosylation site(s)

| Position(s) on known amino acid sequence | Present in variant protein? | Position in variant protein? |
|---|---|---|
| 94 | no | |
| 143 | no | |
| 64 | yes | 64 |
| 245 | no | |
| 398 | no | |
| 117 | no | |

Variant protein HUMPHOSLIP_PEA_2_P31 (SEQ ID NO:1330) is encoded by the following transcript(s): HUMPHOSLIP_PEA_2_T7 (SEQ ID NO:52), for which the sequence(s) is/are given at the end of the application. The coding portion of transcript HUMPHOSLIP_PEA_2_T7 (SEQ ID NO:52) is shown in bold; this coding portion starts at position 276 and ends at position 569. The transcript also has the following SNPs as listed in Table 490 (given according to their position on the nucleotide sequence, with the alternative nucleic acid listed; the last column indicates whether the SNP is known or not; the presence of known SNPs in variant protein HUMPHOSLIP_PEA_2_P31 (SEQ ID NO:1330) sequence provides support for the deduced sequence of this variant protein according to the present invention).

TABLE 490

Nucleic acid SNPs

| SNP position nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 608 | G -> C | Yes |
| 736 | G -> A | Yes |
| 738 | C -> A | Yes |
| 846 | C -> | No |
| 846 | C -> A | No |
| 928 | C -> T | Yes |
| 990 | C -> T | Yes |
| 1005 | T -> | No |
| 1071 | G -> | No |
| 1071 | G -> C | No |
| 1100 | A -> | No |
| 1130 | C -> | No |
| 1253 | C -> | No |
| 1414 | C -> T | Yes |
| 1474 | G -> | No |
| 1505 | C -> T | Yes |
| 1526 | C -> | No |
| 1596 | T -> A | No |
| 1607 | C -> T | Yes |
| 1642 | G -> C | Yes |
| 1699 | T -> A | Yes |
| 1827 | C -> A | Yes |
| 1846 | C -> T | No |
| 1926 | C -> T | Yes |
| 1942 | A -> G | No |
| 1942 | A -> T | No |
| 2007 | A -> G | Yes |
| 2031 | T -> A | No |
| 2108 | G -> T | Yes |
| 2241 | G -> A | Yes |
| 2270 | G -> T | Yes |
| 2450 | G -> A | Yes |
| 2646 | C -> T | Yes |
| 2702 | G -> T | Yes |
| 2842 | C -> T | Yes |
| 2943 | C -> T | Yes |
| 3258 | A -> G | No |

Variant protein HUMPHOSLIP_PEA_2_P33 (SEQ ID NO:1331) according to the present invention has an amino acid sequence as given at the end of the application; it is encoded by transcript(s) HUMPHOSLIP_PEA_2_T14 (SEQ ID NO:53). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison Report Between HUMPHOSLIP_PEA_2_P33 (SEQ ID NO:1331) and PLTP_HUMAN (SEQ ID NO:1433):

1. An isolated chimeric polypeptide encoding for HUMPHOSLIP_PEA_2_P33 (SEQ ID NO:1331), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQ corresponding to amino acids 1-183 of PLTP_HUMAN (SEQ ID NO:1433), which also corresponds to amino acids 1-183 of HUMPHOSLIP_PEA_2_P33 (SEQ ID NO:1331), and a second amino acid sequence being at least 70%, optionally at least 80%, preferably at least 85%, more preferably at least 90% and most preferably at least 95% homologous to a polypeptide having the sequence VWAATGRRVARVGMLSL (SEQ ID NO: 265) corresponding to amino acids 184-200 of HUMPHOSLIP_PEA_2_P33 (SEQ ID NO:1331), wherein said first amino acid sequence and second amino acid sequence are contiguous and in a sequential order.

2. An isolated polypeptide encoding for a tail of HUMPHOSLIP_PEA_2_P33 (SEQ ID NO:1331), comprising a polypeptide being at least 70%, optionally at least about 80%, preferably at least about 85%, more preferably at least about 90% and most preferably at least about 95% homologous to the sequence VWAATGRRVARVGMLSL (SEQ ID NO: 265) in HUMPHOSLIP_PEA_2_P33 (SEQ ID NO:1331).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P33 (SEQ ID NO:1331) also has the following non-silent SNPs (Single Nucleotide Polymorphisms) as listed in Table 491, (given according to their position(s) on the amino acid sequence, with the alternative amino acid(s) listed; the last column indicates whether the SNP is known or not; the presence of known SNPs in variant protein HUMPHOSLIP_PEA_2_P33 (SEQ ID NO:1331) sequence provides support for the deduced sequence of this variant protein according to the present invention).

TABLE 491

Amino acid mutations

| SNP position(s) on amino acid sequence | Alternative amino acid(s) | Previously known SNP? |
| --- | --- | --- |
| 16 | H -> R | Yes |
| 18 | E -> V | Yes |
| 81 | D -> H | Yes |
| 124 | S -> Y | Yes |
| 160 | T -> | No |
| 160 | T -> N | No |

The glycosylation sites of variant protein HUMPHOSLIP_PEA_2_P33 (SEQ ID NO:1331), as compared to the known protein Phospholipid transfer protein precursor (SEQ ID NO:1433), are described in Table 492 (given according to their position(s) on the amino acid sequence in the first column; the second column indicates whether the glycosylation site is present in the variant protein; and the last column indicates whether the position is different on the variant protein).

TABLE 492

Glycosylation site(s)

| Position(s) on known amino acid sequence | Present in variant protein? | Position in variant protein? |
| --- | --- | --- |
| 94 | yes | 94 |
| 143 | yes | 143 |
| 64 | yes | 64 |
| 245 | no | |
| 398 | no | |
| 117 | yes | 117 |

Variant protein HUMPHOSLIP_PEA_2_P33 (SEQ ID NO:1331) is encoded by the following transcript(s): HUMPHOSLIP_PEA_2_T14 (SEQ ID NO:53), for which the sequence(s) is/are given at the end of the application. The coding portion of transcript HUMPHOSLIP_PEA_2_T14 (SEQ ID NO:53) is shown in bold; this coding portion starts at position 276 and ends at position 875. The transcript also has the following SNPs as listed in Table 493 (given according to their position on the nucleotide sequence, with the alternative nucleic acid listed; the last column indicates whether the SNP is known or not; the presence of known SNPs in variant protein HUMPHOSLIP_PEA_2_P33 (SEQ ID NO:1331) sequence provides support for the deduced sequence of this variant protein according to the present invention).

TABLE 493

Nucleic acid SNPs

| SNP position on nucleotide sequence | Alternative nucleic acid | Previously known SNP? |
| --- | --- | --- |
| 174 | G -> T | No |
| 175 | A -> T | No |
| 322 | A -> G | Yes |
| 328 | A -> T | Yes |
| 431 | G -> A | Yes |
| 516 | G -> C | Yes |
| 644 | G -> A | Yes |
| 646 | C -> A | Yes |
| 754 | C -> | No |
| 754 | C -> A | No |
| 921 | C -> T | Yes |
| 983 | C -> T | Yes |
| 998 | T -> | No |
| 1064 | G -> | No |
| 1064 | G -> C | No |
| 1093 | A -> | No |
| 1123 | C -> | No |
| 1246 | C -> | No |
| 1407 | C -> T | Yes |
| 1467 | G -> | No |
| 1498 | C -> T | Yes |
| 1519 | C -> | No |
| 1589 | T -> A | No |
| 1600 | C -> T | Yes |
| 1635 | G -> C | Yes |
| 1692 | T -> A | Yes |
| 1820 | C -> A | Yes |

TABLE 493-continued

| Nucleic acid SNPs | | |
|---|---|---|
| SNP position on nucleotide sequence | Alternative nucleic acid | Previously known SNP? |
| 1839 | C -> T | No |
| 1919 | C -> T | Yes |
| 1935 | A -> G | No |
| 1935 | A -> T | No |
| 2000 | A -> G | Yes |
| 2024 | T -> A | No |
| 2101 | G -> T | Yes |
| 2234 | G -> A | Yes |
| 2263 | G -> T | Yes |
| 2443 | G -> A | Yes |
| 2639 | C -> T | Yes |
| 2695 | G -> T | Yes |
| 2835 | C -> T | Yes |
| 2936 | C -> T | Yes |
| 3251 | A -> G | No |

Variant protein HUMPHOSLIP_PEA_2_P34 (SEQ ID NO:1332) according to the present invention has an amino acid sequence as given at the end of the application; it is encoded by transcript(s) HUMPHOSLIP_PEA_2_T16 (SEQ ID NO:54). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison Report Between HUMPHOSLIP_PEA_2_P34 (SEQ ID NO:1332) and PLTP_HUMAN (SEQ ID NO:1433):

1. An isolated chimeric polypeptide encoding for HUMPHOSLIP_PEA_2_P34 (SEQ ID NO:1332), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYW-FFYDGGYINAS AEGVSIRTGLELSRDPAGRMKVSN-VSCQASVSRMHAAFGGTFKKVYDFLSTFITSGMRF LLNQQICPVLYHAGTVLLNSLLDTVPV corresponding to amino acids 1-205 of PLTP_HUMAN (SEQ ID NO:1433), which also corresponds to amino acids 1-205 of HUMPHOSLIP_PEA_2_P34 (SEQ ID NO:1332), and a second amino acid sequence being at least 70%, optionally at least 80%, preferably at least 85%, more preferably at least 90% and most preferably at least 95% homologous to a polypeptide having the sequence LWTSLLALTIPS (SEQ ID NO: 266) corresponding to amino acids 206-217 of HUMPHOSLIP_PEA_2_P34 (SEQ ID NO:1332), wherein said first amino acid sequence and second amino acid sequence are contiguous and in a sequential order.

2. An isolated polypeptide encoding for a tail of HUMPHOSLIP_PEA_2_P34 (SEQ ID NO:1332), comprising a polypeptide being at least 70%, optionally at least about 80%, preferably at least about 85%, more preferably at least about 90% and most preferably at least about 95% homologous to the sequence LWTSLLALTIPS (SEQ ID NO: 266) in HUMPHOSLIP_PEA_2_P34 (SEQ ID NO:1332).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P34 (SEQ ID NO:1332) also has the following non-silent SNPs (Single Nucleotide Polymorphisms) as listed in Table 494, (given according to their position(s) on the amino acid sequence, with the alternative amino acid(s) listed; the last column indicates whether the SNP is known or not; the presence of known SNPs in variant protein HUMPHOSLIP_PEA_2_P34 (SEQ ID NO:1332) sequence provides support for the deduced sequence of this variant protein according to the present invention).

TABLE 494

| Amino acid mutations | | |
|---|---|---|
| SNP position(s) on amino acid sequence | Alternative amino acid(s) | Previously known SNP? |
| 16 | H -> R | Yes |
| 18 | E -> V | Yes |
| 81 | D -> H | Yes |
| 124 | S -> Y | Yes |
| 160 | T -> | No |
| 160 | T -> N | No |
| 211 | L -> | No |

The glycosylation sites of variant protein HUMPHOSLIP_PEA_2_P34 (SEQ ID NO:1332), as compared to the known protein Phospholipid transfer protein precursor (SEQ ID NO:1433), are described in Table 495 (given according to their position(s) on the amino acid sequence in the first column; the second column indicates whether the glycosylation site is present in the variant protein; and the last column indicates whether the position is different on the variant protein).

TABLE 495

| Glycosylation site(s) | | |
|---|---|---|
| Position(s) on known amino acid sequence | Present in variant protein? | Position in variant protein? |
| 94 | yes | 94 |
| 143 | yes | 143 |
| 64 | yes | 64 |
| 245 | no | |
| 398 | no | |
| 117 | yes | 117 |

Variant protein HUMPHOSLIP_PEA_2_P34 (SEQ ID NO:1332) is encoded by the following transcript(s): HUMPHOSLIP_PEA_2_T16 (SEQ ID NO:54), for which the sequence(s) is/are given at the end of the application. The coding portion of transcript HUMPHOSLIP_PEA_2_T16 (SEQ ID NO:54) is shown in bold; this coding portion starts at position 276 and ends at position 926. The transcript also has the following SNPs as listed in Table 496 (given according to their position on the nucleotide sequence, with the alternative nucleic acid listed; the last column indicates whether the SNP is known or not; the presence of known SNPs in variant protein HUMPHOSLIP_PEA_2_P34 (SEQ ID NO:1332) sequence provides support for the deduced sequence of this variant protein according to the present invention).

TABLE 496

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 516 | G -> C | Yes |
| 644 | G -> A | Yes |
| 646 | C -> A | Yes |
| 754 | C -> | No |
| 754 | C -> A | No |
| 836 | C -> T | Yes |
| 891 | C -> T | Yes |
| 906 | T -> | No |
| 972 | G -> | No |
| 972 | G -> C | No |
| 1001 | A -> | No |
| 1031 | C -> | No |
| 1154 | C -> | No |
| 1315 | C -> T | Yes |
| 1375 | G -> | No |
| 1406 | C -> T | Yes |
| 1427 | C -> | No |
| 1497 | T -> A | No |
| 1508 | C -> T | Yes |
| 1543 | G -> C | Yes |
| 1600 | T -> A | Yes |
| 1728 | C -> A | Yes |
| 1747 | C -> T | No |
| 1827 | C -> T | Yes |
| 1843 | A -> G | No |
| 1843 | A -> T | No |
| 1908 | A -> G | Yes |
| 1932 | T -> A | No |
| 2009 | G -> T | Yes |
| 2142 | G -> A | Yes |
| 2171 | G -> T | Yes |
| 2351 | G -> A | Yes |
| 2547 | C -> T | Yes |
| 2603 | G -> T | Yes |
| 2743 | C -> T | Yes |
| 2844 | C -> T | Yes |
| 3159 | A -> G | No |

Variant protein HUMPHOSLIP_PEA_2_P35 (SEQ ID NO:1333) according to the present invention has an amino acid sequence as given at the end of the application; it is encoded by transcript(s) HUMPHOSLIP_PEA_2_T18 (SEQ ID NO:56). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison Report Between HUMPHOSLIP_PEA_2_P35 (SEQ ID NO:1333) and PLTP_HUMAN (SEQ ID NO:1433):

1. An isolated chimeric polypeptide encoding for HUMPHOSLIP_PEA_2_P35 (SEQ ID NO:1333), comprising a first amino acid sequence being at least 90% homologous to MALFGALFLALLAGAHAEFPGCK-IRVTSKALELVKQEGLRFLEQELETITIPDLRGKEGH FYYNISEVKVTELQLTSSELD-FQPQQELMLQITNASLGLRFRRQLLYWF corresponding to amino acids 1-109 of PLTP_HUMAN (SEQ ID NO:1433), which also corresponds to amino acids 1-109 of HUMPHOSLIP_PEA_2_P35 (SEQ ID NO:1333), a second amino acid sequence bridging amino acid sequence comprising of L, a third amino acid sequence being at least 90% homologous to KVYDFLSTFITSGMRFLLNQQ corresponding to amino acids 163-183 of PLTP_HUMAN (SEQ ID NO:1433), which also corresponds to amino acids 111-131 of HUMPHOSLIP_PEA_2_P35 (SEQ ID NO:1333), and a fourth amino acid sequence being at least 70%, optionally at least 80%, preferably at least 85%, more preferably at least 90% and most preferably at least 95% homologous to a polypeptide having the sequence VWAATGRRVARVG-MLSL (SEQ ID NO: 265) corresponding to amino acids 132-148 of HUMPHOSLIP_PEA_2_P35 (SEQ ID NO:1333), wherein said first amino acid sequence, second amino acid sequence, third amino acid sequence and fourth amino acid sequence are contiguous and in a sequential order.

2. An isolated polypeptide encoding for an edge portion of HUMPHOSLIP_PEA_2_P35 (SEQ ID NO:1333), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FLK having a structure as follows (numbering according to HUMPHOSLIP_PEA_2_P35 (SEQ ID NO:1333)): a sequence starting from any of amino acid numbers 109−x to 109; and ending at any of amino acid numbers 111+((n−2)−x), in which x varies from 0 to n−2.

3. An isolated polypeptide encoding for a tail of HUMPHOSLIP_PEA_2_P35 (SEQ ID NO:1333), comprising a polypeptide being at least 70%, optionally at least about 80%, preferably at least about 85%, more preferably at least about 90% and most preferably at least about 95% homologous to the sequence VWAATGRRVARVGMLSL (SEQ ID NO: 265) in HUMPHOSLIP_PEA_2_P35 (SEQ ID NO:1333).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P35 (SEQ ID NO:1333) also has the following non-silent SNPs (Single Nucleotide Polymorphisms) as listed in Table 497, (given according to their position(s) on the amino acid sequence, with the alternative amino acid(s) listed; the last column indicates whether the SNP is known or not; the presence of known SNPs in variant protein HUMPHOSLIP_PEA_2_P35 (SEQ ID NO:1333) sequence provides support for the deduced sequence of this variant protein according to the present invention).

TABLE 497

Amino acid mutations

| SNP position(s) on amino acid sequence | Alternative amino acid(s) | Previously known SNP? |
|---|---|---|
| 16 | H -> R | Yes |
| 18 | E -> V | Yes |
| 81 | D -> H | Yes |

The glycosylation sites of variant protein HUMPHOSLIP_PEA_2_P35 (SEQ ID NO:1333), as compared to the known protein Phospholipid transfer protein precursor (SEQ ID NO:1433), are described in Table 498 (given according to their position(s) on the amino acid sequence in the first column; the second column indicates whether the glycosylation site is present in the variant protein; and the last column indicates whether the position is different on the variant protein).

TABLE 498

Glycosylation site(s)

| Position(s) on known amino acid sequence | Present in variant protein? | Position in variant protein? |
|---|---|---|
| 94 | yes | 94 |
| 143 | no | |
| 64 | yes | 64 |
| 245 | no | |
| 398 | no | |
| 117 | no | |

Variant protein HUMPHOSLIP_PEA_2_P35 (SEQ ID NO:1333) is encoded by the following transcript(s): HUMPHOSLIP_PEA_2_T18 (SEQ ID NO:56), for which the sequence(s) is/are given at the end of the application. The coding portion of transcript HUMPHOSLIP_PEA_2_T18 (SEQ ID NO:56) is shown in bold; this coding portion starts at position 276 and ends at position 719. The transcript also has the following SNPs as listed in Table 499 (given according to their position on the nucleotide sequence, with the alternative nucleic acid listed; the last column indicates whether the SNP is known or not; the presence of known SNPs in variant protein HUMPHOSLIP_PEA_2_P35 (SEQ ID NO:1333) sequence provides support for the deduced sequence of this variant protein according to the present invention).

TABLE 499

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 516 | G -> C | Yes |
| 765 | C -> T | Yes |
| 827 | C -> T | Yes |
| 842 | T -> | No |
| 908 | G -> | No |
| 908 | G -> C | No |
| 937 | A -> | No |
| 967 | C -> | No |
| 1090 | C -> | No |
| 1251 | C -> T | Yes |
| 1311 | G -> | No |
| 1342 | C -> T | Yes |
| 1363 | C -> | No |
| 1433 | T -> A | No |
| 1444 | C -> T | Yes |
| 1479 | G -> C | Yes |
| 1536 | T -> A | Yes |
| 1664 | C -> A | Yes |
| 1683 | C -> T | No |
| 1763 | C -> T | Yes |
| 1779 | A -> G | No |
| 1779 | A -> T | No |
| 1844 | A -> G | Yes |
| 1868 | T -> A | No |
| 1945 | G -> T | Yes |

TABLE 499-continued

Nucleic acid SNPs

| SNP position on nucleotide sequence | Alternative nucleic acid | Previously known SNP? |
|---|---|---|
| 2078 | G -> A | Yes |
| 2107 | G -> T | Yes |
| 2287 | G -> A | Yes |
| 2483 | C -> T | Yes |
| 2539 | G -> T | Yes |
| 2679 | C -> T | Yes |
| 2780 | C -> T | Yes |
| 3095 | A -> G | No |

As noted above, cluster HUMPHOSLIP features 53 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMPHOSLIP_PEA_2_node_0 (SEQ ID NO:518) according to the present invention is supported by 150 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 500 below describes the starting and ending position of this segment on each transcript.

TABLE 500

Segment location on transcripts

| Transcript name | Segment starting position | Segment ending position |
|---|---|---|
| HUMPHOSLIP_PEA_2_T6 (SEQ ID NO: 51) | 1 | 264 |
| HUMPHOSLIP_PEA_2_T7 (SEQ ID NO: 52) | 1 | 264 |
| HUMPHOSLIP_PEA_2_T14 (SEQ ID NO: 53) | 1 | 264 |
| HUMPHOSLIP_PEA_2_T16 (SEQ ID NO: 54) | 1 | 264 |
| HUMPHOSLIP_PEA_2_T17 (SEQ ID NO: 55) | 1 | 264 |
| HUMPHOSLIP_PEA_2_T18 (SEQ ID NO: 56) | 1 | 264 |
| HUMPHOSLIP_PEA_2_T19 (SEQ ID NO: 57) | 1 | 264 |

Segment cluster HUMPHOSLIP_PEA_2_node_19 (SEQ ID NO:519) according to the present invention is supported by 186 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54) and HUMPHOSLIP_PEA_2_T19 (SEQ ID NO:57). Table 501 below describes the starting and ending position of this segment on each transcript.

TABLE 501

Segment location on transcripts

| Transcript name | Segment starting position | Segment ending position |
|---|---|---|
| HUMPHOSLIP_PEA_2_T6 (SEQ ID NO: 51) | 559 | 714 |
| HUMPHOSLIP_PEA_2_T7 (SEQ ID NO: 52) | 697 | 852 |
| HUMPHOSLIP_PEA_2_T14 (SEQ ID NO: 53) | 605 | 760 |
| HUMPHOSLIP_PEA_2_T16 (SEQ ID NO: 54) | 605 | 760 |
| HUMPHOSLIP_PEA_2_T19 (SEQ ID NO: 57) | 605 | 760 |

Segment cluster HUMPHOSLIP_PEA_2_node_34 (SEQ ID NO:520) according to the present invention is supported by 191 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 502 below describes the starting and ending position of this segment on each transcript.

TABLE 502

Segment location on transcripts

| Transcript name | Segment starting position | Segment ending position |
|---|---|---|
| HUMPHOSLIP_PEA_2_T6 (SEQ ID NO: 51) | 971 | 1111 |
| HUMPHOSLIP_PEA_2_T7 (SEQ ID NO: 52) | 1109 | 1249 |
| HUMPHOSLIP_PEA_2_T14 (SEQ ID NO: 53) | 1102 | 1242 |
| HUMPHOSLIP_PEA_2_T16 (SEQ ID NO: 54) | 1010 | 1150 |
| HUMPHOSLIP_PEA_2_T17 (SEQ ID NO: 55) | 732 | 872 |
| HUMPHOSLIP_PEA_2_T18 (SEQ ID NO: 56) | 946 | 1086 |
| HUMPHOSLIP_PEA_2_T19 (SEQ ID NO: 57) | 1017 | 1157 |

Segment cluster HUMPHOSLIP_PEA_2_node_68 (SEQ ID NO:521) according to the present invention is supported by 131 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 503 below describes the starting and ending position of this segment on each transcript.

TABLE 503

Segment location on transcripts

| Transcript name | Segment starting position | Segment ending position |
|---|---|---|
| HUMPHOSLIP_PEA_2_T6 (SEQ ID NO: 51) | 1867 | 2285 |
| HUMPHOSLIP_PEA_2_T7 (SEQ ID NO: 52) | 2005 | 2423 |
| HUMPHOSLIP_PEA_2_T14 (SEQ ID NO: 53) | 1998 | 2416 |
| HUMPHOSLIP_PEA_2_T16 (SEQ ID NO: 54) | 1906 | 2324 |
| HUMPHOSLIP_PEA_2_T17 (SEQ ID NO: 55) | 1628 | 2046 |
| HUMPHOSLIP_PEA_2_T18 (SEQ ID NO: 56) | 1842 | 2260 |
| HUMPHOSLIP_PEA_2_T19 (SEQ ID NO: 57) | 1996 | 2414 |

Segment cluster HUMPHOSLIP_PEA_2_node_70 (SEQ ID NO:522) according to the present invention is supported by 5 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 504 below describes the starting and ending position of this segment on each transcript.

TABLE 504

Segment location on transcripts

| Transcript name | Segment starting position | Segment ending position |
|---|---|---|
| HUMPHOSLIP_PEA_2_T6 (SEQ ID NO: 51) | 2298 | 2529 |
| HUMPHOSLIP_PEA_2_T7 (SEQ ID NO: 52) | 2436 | 2667 |
| HUMPHOSLIP_PEA_2_T14 (SEQ ID NO: 53) | 2429 | 2660 |
| HUMPHOSLIP_PEA_2_T16 (SEQ ID NO: 54) | 2337 | 2568 |
| HUMPHOSLIP_PEA_2_T17 (SEQ ID NO: 55) | 2059 | 2290 |
| HUMPHOSLIP_PEA_2_T18 (SEQ ID NO: 56) | 2273 | 2504 |
| HUMPHOSLIP_PEA_2_T19 (SEQ ID NO: 57) | 2427 | 2658 |

Segment cluster HUMPHOSLIP_PEA_2_node_75 (SEQ ID NO:523) according to the present invention is supported by 14 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 505 below describes the starting and ending position of this segment on each transcript.

TABLE 505

Segment location on transcripts

| Transcript name | Segment starting position | Segment ending position |
| --- | --- | --- |
| HUMPHOSLIP_PEA_2_T6 (SEQ ID NO: 51) | 2846 | 3125 |
| HUMPHOSLIP_PEA_2_T7 (SEQ ID NO: 52) | 2984 | 3263 |
| HUMPHOSLIP_PEA_2_T14 (SEQ ID NO: 53) | 2977 | 3256 |
| HUMPHOSLIP_PEA_2_T16 (SEQ ID NO: 54) | 2885 | 3164 |
| HUMPHOSLIP_PEA_2_T17 (SEQ ID NO: 55) | 2607 | 2886 |
| HUMPHOSLIP_PEA_2_T18 (SEQ ID NO: 56) | 2821 | 3100 |
| HUMPHOSLIP_PEA_2_T19 (SEQ ID NO: 57) | 2975 | 3254 |

According to an optional embodiment of the present invention, short segments related to the above cluster are also provided. These segments are up to about 120 bp in length, and so are included in a separate description.

Segment cluster HUMPHOSLIP_PEA_2_node_2 (SEQ ID NO:524) according to the present invention is supported by 159 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 506 below describes the starting and ending position of this segment on each transcript.

TABLE 506

Segment location on transcripts

| Transcript name | Segment starting position | Segment ending position |
| --- | --- | --- |
| HUMPHOSLIP_PEA_2_T6 (SEQ ID NO: 51) | 265 | 337 |
| HUMPHOSLIP_PEA_2_T7 (SEQ ID NO: 52) | 265 | 337 |
| HUMPHOSLIP_PEA_2_T14 (SEQ ID NO: 53) | 265 | 337 |
| HUMPHOSLIP_PEA_2_T16 (SEQ ID NO: 54) | 265 | 337 |
| HUMPHOSLIP_PEA_2_T17 (SEQ ID NO: 55) | 265 | 337 |
| HUMPHOSLIP_PEA_2_T18 (SEQ ID NO: 56) | 265 | 337 |
| HUMPHOSLIP_PEA_2_T19 (SEQ ID NO: 57) | 265 | 337 |

Segment cluster HUMPHOSLIP_PEA_2_node_3 (SEQ ID NO:525) according to the present invention can be found in the following transcript(s): HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 507 below describes the starting and ending position of this segment on each transcript.

TABLE 507

Segment location on transcripts

| Transcript name | Segment starting position | Segment ending position |
| --- | --- | --- |
| HUMPHOSLIP_PEA_2_T7 (SEQ ID NO: 52) | 338 | 355 |
| HUMPHOSLIP_PEA_2_T14 (SEQ ID NO: 53) | 338 | 355 |
| HUMPHOSLIP_PEA_2_T16 (SEQ ID NO: 54) | 338 | 355 |
| HUMPHOSLIP_PEA_2_T17 (SEQ ID NO: 55) | 338 | 355 |
| HUMPHOSLIP_PEA_2_T18 (SEQ ID NO: 56) | 338 | 355 |
| HUMPHOSLIP_PEA_2_T19 (SEQ ID NO: 57) | 338 | 355 |

Segment cluster HUMPHOSLIP_PEA_2_node_4 (SEQ ID NO:526) according to the present invention can be found in the following transcript(s): HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 508 below describes the starting and ending position of this segment on each transcript.

TABLE 508

Segment location on transcripts

| Transcript name | Segment starting position | Segment ending position |
| --- | --- | --- |
| HUMPHOSLIP_PEA_2_T7 (SEQ ID NO: 52) | 356 | 375 |
| HUMPHOSLIP_PEA_2_T14 (SEQ ID NO: 53) | 356 | 375 |
| HUMPHOSLIP_PEA_2_T16 (SEQ ID NO: 54) | 356 | 375 |
| HUMPHOSLIP_PEA_2_T17 (SEQ ID NO: 55) | 356 | 375 |
| HUMPHOSLIP_PEA_2_T18 (SEQ ID NO: 56) | 356 | 375 |
| HUMPHOSLIP_PEA_2_T19 (SEQ ID NO: 57) | 356 | 375 |

Segment cluster HUMPHOSLIP_PEA_2_node_6 (SEQ ID NO:527) according to the present invention can be found in the following transcript(s): HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 509 below describes the starting and ending position of this segment on each transcript.

TABLE 509

Segment location on transcripts

| Transcript name | Segment starting position | Segment ending position |
|---|---|---|
| HUMPHOSLIP_PEA_2_T7 (SEQ ID NO: 52) | 376 | 383 |
| HUMPHOSLIP_PEA_2_T14 (SEQ ID NO: 53) | 376 | 383 |
| HUMPHOSLIP_PEA_2_T16 (SEQ ID NO: 54) | 376 | 383 |
| HUMPHOSLIP_PEA_2_T17 (SEQ ID NO: 55) | 376 | 383 |
| HUMPHOSLIP_PEA_2_T18 (SEQ ID NO: 56) | 376 | 383 |
| HUMPHOSLIP_PEA_2_T19 (SEQ ID NO: 57) | 376 | 383 |

Segment cluster HUMPHOSLIP_PEA_2_node_7 (SEQ ID NO:528) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 510 below describes the starting and ending position of this segment on each transcript.

TABLE 510

Segment location on transcripts

| Transcript name | Segment starting position | Segment ending position |
|---|---|---|
| HUMPHOSLIP_PEA_2_T6 (SEQ ID NO: 51) | 338 | 343 |
| HUMPHOSLIP_PEA_2_T7 (SEQ ID NO: 52) | 384 | 389 |
| HUMPHOSLIP_PEA_2_T14 (SEQ ID NO: 53) | 384 | 389 |
| HUMPHOSLIP_PEA_2_T16 (SEQ ID NO: 54) | 384 | 389 |
| HUMPHOSLIP_PEA_2_T17 (SEQ ID NO: 55) | 384 | 389 |
| HUMPHOSLIP_PEA_2_T18 (SEQ ID NO: 56) | 384 | 389 |
| HUMPHOSLIP_PEA_2_T19 (SEQ ID NO: 57) | 384 | 389 |

Segment cluster HUMPHOSLIP_PEA_2_node_8 (SEQ ID NO:529) according to the present invention is supported by 171 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 511 below describes the starting and ending position of this segment on each transcript.

TABLE 511

Segment location on transcripts

| Transcript name | Segment starting position | Segment ending position |
|---|---|---|
| HUMPHOSLIP_PEA_2_T6 (SEQ ID NO: 51) | 344 | 378 |
| HUMPHOSLIP_PEA_2_T7 (SEQ ID NO: 52) | 390 | 424 |
| HUMPHOSLIP_PEA_2_T14 (SEQ ID NO: 53) | 390 | 424 |
| HUMPHOSLIP_PEA_2_T16 (SEQ ID NO: 54) | 390 | 424 |
| HUMPHOSLIP_PEA_2_T17 (SEQ ID NO: 55) | 390 | 424 |
| HUMPHOSLIP_PEA_2_T18 (SEQ ID NO: 56) | 390 | 424 |
| HUMPHOSLIP_PEA_2_T19 (SEQ ID NO: 57) | 390 | 424 |

Segment cluster HUMPHOSLIP_PEA_2_node_9 (SEQ ID NO:530) according to the present invention is supported by 168 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 512 below describes the starting and ending position of this segment on each transcript.

TABLE 512

Segment location on transcripts

| Transcript name | Segment starting position | Segment ending position |
|---|---|---|
| HUMPHOSLIP_PEA_2_T6 (SEQ ID NO: 51) | 379 | 429 |
| HUMPHOSLIP_PEA_2_T7 (SEQ ID NO: 52) | 425 | 475 |
| HUMPHOSLIP_PEA_2_T14 (SEQ ID NO: 53) | 425 | 475 |
| HUMPHOSLIP_PEA_2_T16 (SEQ ID NO: 54) | 425 | 475 |
| HUMPHOSLIP_PEA_2_T17 (SEQ ID NO: 55) | 425 | 475 |
| HUMPHOSLIP_PEA_2_T18 (SEQ ID NO: 56) | 425 | 475 |
| HUMPHOSLIP_PEA_2_T19 (SEQ ID NO: 57) | 425 | 475 |

Segment cluster HUMPHOSLIP_PEA_2_node_14 (SEQ ID NO:531) according to the present invention is supported by 6 libraries. The number of libraries was determined as previously described. This segment can be found in the following transcript(s): HUMPHOSLIP_PEA_2_T7 (SEQ ID NO:52). Table 513 below describes the starting and ending position of this segment on each transcript.

TABLE 513

Segment location on transcripts

| Transcript name | Segment starting position | Segment ending position |
|---|---|---|
| HUMPHOSLIP_PEA_2_T7 (SEQ ID NO: 52) | 476 | 567 |

Segment cluster HUMPHOSLIP_PEA_2_node_15 (SEQ ID NO:532) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T18 (SEQ ID NO:56) and HUMPHOSLIP_PEA_2_T19 (SEQ ID NO:57). Table 514 below describes the starting and ending position of this segment on each transcript.

TABLE 514

Segment location on transcripts

| Transcript name | Segment starting position | Segment ending position |
|---|---|---|
| HUMPHOSLIP_PEA_2_T6 (SEQ ID NO: 51) | 430 | 445 |
| HUMPHOSLIP_PEA_2_T7 (SEQ ID NO: 52) | 568 | 583 |
| HUMPHOSLIP_PEA_2_T14 (SEQ ID NO: 53) | 476 | 491 |
| HUMPHOSLIP_PEA_2_T16 (SEQ ID NO: 54) | 476 | 491 |
| HUMPHOSLIP_PEA_2_T18 (SEQ ID NO: 56) | 476 | 491 |
| HUMPHOSLIP_PEA_2_T19 (SEQ ID NO: 57) | 476 | 491 |

Segment cluster HUMPHOSLIP_PEA_2_node_16 (SEQ ID NO:533) according to the present invention is supported by 179 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T18 (SEQ ID NO:56) and HUMPHOSLIP_PEA_2_T19 (SEQ ID NO:57). Table 515 below describes the starting and ending position of this segment on each transcript.

TABLE 515

Segment location on transcripts

| Transcript name | Segment starting position | Segment ending position |
|---|---|---|
| HUMPHOSLIP_PEA_2_T6 (SEQ ID NO: 51) | 446 | 534 |
| HUMPHOSLIP_PEA_2_T7 (SEQ ID NO: 52) | 584 | 672 |
| HUMPHOSLIP_PEA_2_T14 (SEQ ID NO: 53) | 492 | 580 |
| HUMPHOSLIP_PEA_2_T16 (SEQ ID NO: 54) | 492 | 580 |
| HUMPHOSLIP_PEA_2_T18 (SEQ ID NO: 56) | 492 | 580 |
| HUMPHOSLIP_PEA_2_T19 (SEQ ID NO: 57) | 492 | 580 |

Segment cluster HUMPHOSLIP_PEA_2_node_17 (SEQ ID NO:534) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T18 (SEQ ID NO:56) and HUMPHOSLIP_PEA_2_T19 (SEQ ID NO:57). Table 516 below describes the starting and ending position of this segment on each transcript.

TABLE 516

Segment location on transcripts

| Transcript name | Segment starting position | Segment ending position |
|---|---|---|
| HUMPHOSLIP_PEA_2_T6 (SEQ ID NO: 51) | 535 | 558 |
| HUMPHOSLIP_PEA_2_T7 (SEQ ID NO: 52) | 673 | 696 |
| HUMPHOSLIP_PEA_2_T14 (SEQ ID NO: 53) | 581 | 604 |
| HUMPHOSLIP_PEA_2_T16 (SEQ ID NO: 54) | 581 | 604 |
| HUMPHOSLIP_PEA_2_T18 (SEQ ID NO: 56) | 581 | 604 |
| HUMPHOSLIP_PEA_2_T19 (SEQ ID NO: 57) | 581 | 604 |

Segment cluster HUMPHOSLIP_PEA_2_node_23 (SEQ ID NO:535) according to the present invention is supported by 168 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 517 below describes the starting and ending position of this segment on each transcript.

TABLE 517

Segment location on transcripts

| Transcript name | Segment starting position | Segment ending position |
|---|---|---|
| HUMPHOSLIP_PEA_2_T6 (SEQ ID NO: 51) | 715 | 766 |
| HUMPHOSLIP_PEA_2_T7 (SEQ ID NO: 52) | 853 | 904 |
| HUMPHOSLIP_PEA_2_T14 (SEQ ID NO: 53) | 761 | 812 |
| HUMPHOSLIP_PEA_2_T16 (SEQ ID | 761 | 812 |

TABLE 517-continued

Segment location on transcripts

| Transcript name | Segment starting position | Segment ending position |
|---|---|---|
| NO: 54) | | |
| HUMPHOSLIP_PEA_2_T17 (SEQ ID NO: 55) | 476 | 527 |
| HUMPHOSLIP_PEA_2_T18 (SEQ ID NO: 56) | 605 | 656 |
| HUMPHOSLIP_PEA_2_T19 (SEQ ID NO: 57) | 761 | 812 |

Segment cluster HUMPHOSLIP_PEA_2_node_24 (SEQ ID NO:536) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 518 below describes the starting and ending position of this segment on each transcript.

TABLE 518

Segment location on transcripts

| Transcript name | Segment starting position | Segment ending position |
|---|---|---|
| HUMPHOSLIP_PEA_2_T6 (SEQ ID NO: 51) | 767 | 778 |
| HUMPHOSLIP_PEA_2_T7 (SEQ ID NO: 52) | 905 | 916 |
| HUMPHOSLIP_PEA_2_T14 (SEQ ID NO: 53) | 813 | 824 |
| HUMPHOSLIP_PEA_2_T16 (SEQ ID NO: 54) | 813 | 824 |
| HUMPHOSLIP_PEA_2_T17 (SEQ ID NO: 55) | 528 | 539 |
| HUMPHOSLIP_PEA_2_T18 (SEQ ID NO: 56) | 657 | 668 |
| HUMPHOSLIP_PEA_2_T19 (SEQ ID NO: 57) | 813 | 824 |

Segment cluster HUMPHOSLIP_PEA_2_node_25 (SEQ ID NO:537) according to the present invention is supported by 5 libraries. The number of libraries was determined as previously described. This segment can be found in the following transcript(s): HUMPHOSLIP_PEA_2_T14 (SEQ ID NO:53) and HUMPHOSLIP_PEA_2_T18 (SEQ ID NO:56). Table 519 below describes the starting and ending position of this segment on each transcript.

TABLE 519

Segment location on transcripts

| Transcript name | Segment starting position | Segment ending position |
|---|---|---|
| HUMPHOSLIP_PEA_2_T14 (SEQ ID NO: 53) | 825 | 909 |
| HUMPHOSLIP_PEA_2_T18 (SEQ ID NO: 56) | 669 | 753 |

Segment cluster HUMPHOSLIP_PEA_2_node_26 (SEQ ID NO:538) according to the present invention is supported by 163 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 520 below describes the starting and ending position of this segment on each transcript.

TABLE 520

Segment location on transcripts

| Transcript name | Segment starting position | Segment ending position |
|---|---|---|
| HUMPHOSLIP_PEA_2_T6 (SEQ ID NO: 51) | 779 | 842 |
| HUMPHOSLIP_PEA_2_T7 (SEQ ID NO: 52) | 917 | 980 |
| HUMPHOSLIP_PEA_2_T14 (SEQ ID NO: 53) | 910 | 973 |
| HUMPHOSLIP_PEA_2_T16 (SEQ ID NO: 54) | 825 | 888 |
| HUMPHOSLIP_PEA_2_T17 (SEQ ID NO: 55) | 540 | 603 |
| HUMPHOSLIP_PEA_2_T18 (SEQ ID NO: 56) | 754 | 817 |
| HUMPHOSLIP_PEA_2_T19 (SEQ ID NO: 57) | 825 | 888 |

Segment cluster HUMPHOSLIP_PEA_2_node_29 (SEQ ID NO:539) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 521 below describes the starting and ending position of this segment on each transcript.

TABLE 521

Segment location on transcripts

| Transcript name | Segment starting position | Segment ending position |
|---|---|---|
| HUMPHOSLIP_PEA_2_T6 (SEQ ID NO: 51) | 843 | 849 |
| HUMPHOSLIP_PEA_2_T7 (SEQ ID NO: 52) | 981 | 987 |
| HUMPHOSLIP_PEA_2_T14 (SEQ ID NO: 53) | 974 | 980 |
| HUMPHOSLIP_PEA_2_T17 (SEQ ID NO: 55) | 604 | 610 |
| HUMPHOSLIP_PEA_2_T18 (SEQ ID NO: 56) | 818 | 824 |
| HUMPHOSLIP_PEA_2_T19 (SEQ ID NO: 57) | 889 | 895 |

Segment cluster HUMPHOSLIP_PEA_2_node_30 (SEQ ID NO:540) according to the present invention is supported by 181 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPH- OSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 522 below describes the starting and ending position of this segment on each transcript.

TABLE 522

Segment location on transcripts

| Transcript name | Segment starting position | Segment ending position |
|---|---|---|
| HUMPHOSLIP_PEA_2_T6 (SEQ ID NO: 51) | 850 | 934 |
| HUMPHOSLIP_PEA_2_T7 (SEQ ID NO: 52) | 988 | 1072 |
| HUMPHOSLIP_PEA_2_T14 (SEQ ID NO: 53) | 981 | 1065 |
| HUMPHOSLIP_PEA_2_T16 (SEQ ID NO: 54) | 889 | 973 |
| HUMPHOSLIP_PEA_2_T17 (SEQ ID NO: 55) | 611 | 695 |
| HUMPHOSLIP_PEA_2_T18 (SEQ ID NO: 56) | 825 | 909 |
| HUMPHOSLIP_PEA_2_T19 (SEQ ID NO: 57) | 896 | 980 |

Segment cluster HUMPHOSLIP_PEA_2_node_33 (SEQ ID NO:541) according to the present invention is supported by 173 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 523 below describes the starting and ending position of this segment on each transcript.

TABLE 523

Segment location on transcripts

| Transcript name | Segment starting position | Segment ending position |
|---|---|---|
| HUMPHOSLIP_PEA_2_T6 (SEQ ID NO: 51) | 935 | 970 |
| HUMPHOSLIP_PEA_2_T7 (SEQ ID NO: 52) | 1073 | 1108 |
| HUMPHOSLIP_PEA_2_T14 (SEQ ID NO: 53) | 1066 | 1101 |
| HUMPHOSLIP_PEA_2_T16 (SEQ ID NO: 54) | 974 | 1009 |
| HUMPHOSLIP_PEA_2_T17 (SEQ ID NO: 55) | 696 | 731 |
| HUMPHOSLIP_PEA_2_T18 (SEQ ID NO: 56) | 910 | 945 |
| HUMPHOSLIP_PEA_2_T19 (SEQ ID NO: 57) | 981 | 1016 |

Segment cluster HUMPHOSLIP_PEA_2_node_36 (SEQ ID NO:542) according to the present invention is supported by 163 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 524 below describes the starting and ending position of this segment on each transcript.

TABLE 524

Segment location on transcripts

| Transcript name | Segment starting position | Segment ending position |
|---|---|---|
| HUMPHOSLIP_PEA_2_T6 (SEQ ID NO: 51) | 1112 | 1156 |
| HUMPHOSLIP_PEA_2_T7 (SEQ ID NO: 52) | 1250 | 1294 |
| HUMPHOSLIP_PEA_2_T14 (SEQ ID NO: 53) | 1243 | 1287 |
| HUMPHOSLIP_PEA_2_T16 (SEQ ID NO: 54) | 1151 | 1195 |
| HUMPHOSLIP_PEA_2_T17 (SEQ ID NO: 55) | 873 | 917 |
| HUMPHOSLIP_PEA_2_T18 (SEQ ID NO: 56) | 1087 | 1131 |
| HUMPHOSLIP_PEA_2_T19 (SEQ ID NO: 57) | 1158 | 1202 |

Segment cluster HUMPHOSLIP_PEA_2_node_37 (SEQ ID NO:543) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 525 below describes the starting and ending position of this segment on each transcript.

TABLE 525

Segment location on transcripts

| Transcript name | Segment starting position | Segment ending position |
|---|---|---|
| HUMPHOSLIP_PEA_2_T6 (SEQ ID NO: 51) | 1157 | 1171 |
| HUMPHOSLIP_PEA_2_T7 (SEQ ID NO: 52) | 1295 | 1309 |
| HUMPHOSLIP_PEA_2_T14 (SEQ ID NO: 53) | 1288 | 1302 |
| HUMPHOSLIP_PEA_2_T16 (SEQ ID NO: 54) | 1196 | 1210 |
| HUMPHOSLIP_PEA_2_T17 (SEQ ID NO: 55) | 918 | 932 |
| HUMPHOSLIP_PEA_2_T18 (SEQ ID NO: 56) | 1132 | 1146 |
| HUMPHOSLIP_PEA_2_T19 (SEQ ID NO: 57) | 1203 | 1217 |

Segment cluster HUMPHOSLIP_PEA_2_node_39 (SEQ ID NO:544) according to the present invention is supported by 166 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 525 below describes the starting and ending position of this segment on each transcript.

TABLE 525

Segment location on transcripts

| Transcript name | Segment starting position | Segment ending position |
|---|---|---|
| HUMPHOSLIP_PEA_2_T6 (SEQ ID NO: 51) | 1172 | 1201 |
| HUMPHOSLIP_PEA_2_T7 (SEQ ID NO: 52) | 1310 | 1339 |
| HUMPHOSLIP_PEA_2_T14 (SEQ ID NO: 53) | 1303 | 1332 |
| HUMPHOSLIP_PEA_2_T16 (SEQ ID NO: 54) | 1211 | 1240 |
| HUMPHOSLIP_PEA_2_T17 (SEQ ID NO: 55) | 933 | 962 |
| HUMPHOSLIP_PEA_2_T18 (SEQ ID NO: 56) | 1147 | 1176 |
| HUMPHOSLIP_PEA_2_T19 (SEQ ID NO: 57) | 1218 | 1247 |

Segment cluster HUMPHOSLIP_PEA_2_node_40 (SEQ ID NO:545) according to the present invention is supported by 199 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 526 below describes the starting and ending position of this segment on each transcript.

TABLE 526

Segment location on transcripts

| Transcript name | Segment starting position | Segment ending position |
|---|---|---|
| HUMPHOSLIP_PEA_2_T6 (SEQ ID NO: 51) | 1202 | 1288 |
| HUMPHOSLIP_PEA_2_T7 (SEQ ID NO: 52) | 1340 | 1426 |
| HUMPHOSLIP_PEA_2_T14 (SEQ ID NO: 53) | 1333 | 1419 |
| HUMPHOSLIP_PEA_2_T16 (SEQ ID NO: 54) | 1241 | 1327 |
| HUMPHOSLIP_PEA_2_T17 (SEQ ID NO: 55) | 963 | 1049 |
| HUMPHOSLIP_PEA_2_T18 (SEQ ID NO: 56) | 1177 | 1263 |
| HUMPHOSLIP_PEA_2_T19 (SEQ ID NO: 57) | 1248 | 1334 |

Segment cluster HUMPHOSLIP_PEA_2_node_41 (SEQ ID NO:546) according to the present invention is supported by 186 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 527 below describes the starting and ending position of this segment on each transcript.

TABLE 527

Segment location on transcripts

| Transcript name | Segment starting position | Segment ending position |
|---|---|---|
| HUMPHOSLIP_PEA_2_T6 (SEQ ID NO: 51) | 1289 | 1318 |
| HUMPHOSLIP_PEA_2_T7 (SEQ ID NO: 52) | 1427 | 1456 |
| HUMPHOSLIP_PEA_2_T14 (SEQ ID NO: 53) | 1420 | 1449 |
| HUMPHOSLIP_PEA_2_T16 (SEQ ID NO: 54) | 1328 | 1357 |
| HUMPHOSLIP_PEA_2_T17 (SEQ ID NO: 55) | 1050 | 1079 |
| HUMPHOSLIP_PEA_2_T18 (SEQ ID NO: 56) | 1264 | 1293 |
| HUMPHOSLIP_PEA_2_T19 (SEQ ID NO: 57) | 1335 | 1364 |

Segment cluster HUMPHOSLIP_PEA_2_node_42 (SEQ ID NO:547) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 528 below describes the starting and ending position of this segment on each transcript.

TABLE 528

Segment location on transcripts

| Transcript name | Segment starting position | Segment ending position |
|---|---|---|
| HUMPHOSLIP_PEA_2_T6 (SEQ ID NO: 51) | 1319 | 1336 |
| HUMPHOSLIP_PEA_2_T7 (SEQ ID NO: 52) | 1457 | 1474 |
| HUMPHOSLIP_PEA_2_T14 (SEQ ID NO: 53) | 1450 | 1467 |
| HUMPHOSLIP_PEA_2_T16 (SEQ ID NO: 54) | 1358 | 1375 |
| HUMPHOSLIP_PEA_2_T17 (SEQ ID NO: 55) | 1080 | 1097 |
| HUMPHOSLIP_PEA_2_T18 (SEQ ID NO: 56) | 1294 | 1311 |
| HUMPHOSLIP_PEA_2_T19 (SEQ ID NO: 57) | 1365 | 1382 |

Segment cluster HUMPHOSLIP_PEA_2_node_44 (SEQ ID NO:548) according to the present invention is supported by 185 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 529 below describes the starting and ending position of this segment on each transcript.

TABLE 529

Segment location on transcripts

| Transcript name | Segment starting position | Segment ending position |
|---|---|---|
| HUMPHOSLIP_PEA_2_T6 (SEQ ID NO: 51) | 1337 | 1363 |
| HUMPHOSLIP_PEA_2_T7 (SEQ ID NO: 52) | 1475 | 1501 |
| HUMPHOSLIP_PEA_2_T14 (SEQ ID NO: 53) | 1468 | 1494 |
| HUMPHOSLIP_PEA_2_T16 (SEQ ID NO: 54) | 1376 | 1402 |
| HUMPHOSLIP_PEA_2_T17 (SEQ ID NO: 55) | 1098 | 1124 |
| HUMPHOSLIP_PEA_2_T18 (SEQ ID NO: 56) | 1312 | 1338 |
| HUMPHOSLIP_PEA_2_T19 (SEQ ID NO: 57) | 1383 | 1409 |

Segment cluster HUMPHOSLIP_PEA_2_node_45 (SEQ ID NO:549) according to the present invention is supported by 197 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 530 below describes the starting and ending position of this segment on each transcript.

TABLE 530

Segment location on transcripts

| Transcript name | Segment starting position | Segment ending position |
|---|---|---|
| HUMPHOSLIP_PEA_2_T6 (SEQ ID NO: 51) | 1364 | 1404 |
| HUMPHOSLIP_PEA_2_T7 (SEQ ID NO: 52) | 1502 | 1542 |
| HUMPHOSLIP_PEA_2_T14 (SEQ ID NO: 53) | 1495 | 1535 |
| HUMPHOSLIP_PEA_2_T16 (SEQ ID NO: 54) | 1403 | 1443 |
| HUMPHOSLIP_PEA_2_T17 (SEQ ID NO: 55) | 1125 | 1165 |
| HUMPHOSLIP_PEA_2_T18 (SEQ ID NO: 56) | 1339 | 1379 |
| HUMPHOSLIP_PEA_2_T19 (SEQ ID NO: 57) | 1410 | 1450 |

Segment cluster HUMPHOSLIP_PEA_2_node_47 (SEQ ID NO:550) according to the present invention is supported by 223 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 531 below describes the starting and ending position of this segment on each transcript.

TABLE 531

Segment location on transcripts

| Transcript name | Segment starting position | Segment ending position |
|---|---|---|
| HUMPHOSLIP_PEA_2_T6 (SEQ ID NO: 51) | 1405 | 1447 |
| HUMPHOSLIP_PEA_2_T7 (SEQ ID NO: 52) | 1543 | 1585 |
| HUMPHOSLIP_PEA_2_T14 (SEQ ID NO: 53) | 1536 | 1578 |
| HUMPHOSLIP_PEA_2_T16 (SEQ ID NO: 54) | 1444 | 1486 |
| HUMPHOSLIP_PEA_2_T17 (SEQ ID NO: 55) | 1166 | 1208 |
| HUMPHOSLIP_PEA_2_T18 (SEQ ID NO: 56) | 1380 | 1422 |
| HUMPHOSLIP_PEA_2_T19 (SEQ ID NO: 57) | 1451 | 1493 |

Segment cluster HUMPHOSLIP_PEA_2_node_51 (SEQ ID NO:551) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 532 below describes the starting and ending position of this segment on each transcript.

TABLE 532

Segment location on transcripts

| Transcript name | Segment starting position | Segment ending position |
|---|---|---|
| HUMPHOSLIP_PEA_2_T6 (SEQ ID NO: 51) | 1448 | 1462 |
| HUMPHOSLIP_PEA_2_T7 (SEQ ID NO: 52) | 1586 | 1600 |
| HUMPHOSLIP_PEA_2_T14 (SEQ ID NO: 53) | 1579 | 1593 |
| HUMPHOSLIP_PEA_2_T16 (SEQ ID NO: 54) | 1487 | 1501 |
| HUMPHOSLIP_PEA_2_T17 (SEQ ID NO: 55) | 1209 | 1223 |
| HUMPHOSLIP_PEA_2_T18 (SEQ ID NO: 56) | 1423 | 1437 |
| HUMPHOSLIP_PEA_2_T19 (SEQ ID NO: 57) | 1494 | 1508 |

Segment cluster HUMPHOSLIP_PEA_2_node_52 (SEQ ID NO:552) according to the present invention is supported by 235 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 533 below describes the starting and ending position of this segment on each transcript.

TABLE 533

Segment location on transcripts

| Transcript name | Segment starting position | Segment ending position |
|---|---|---|
| HUMPHOSLIP_PEA_2_T6 (SEQ ID NO: 51) | 1463 | 1511 |
| HUMPHOSLIP_PEA_2_T7 (SEQ ID NO: 52) | 1601 | 1649 |
| HUMPHOSLIP_PEA_2_T14 (SEQ ID NO: 53) | 1594 | 1642 |
| HUMPHOSLIP_PEA_2_T16 (SEQ ID NO: 54) | 1502 | 1550 |
| HUMPHOSLIP_PEA_2_T17 (SEQ ID NO: 55) | 1224 | 1272 |
| HUMPHOSLIP_PEA_2_T18 (SEQ ID NO: 56) | 1438 | 1486 |
| HUMPHOSLIP_PEA_2_T19 (SEQ ID NO: 57) | 1509 | 1557 |

Segment cluster HUMPHOSLIP_PEA_2_node_53 (SEQ ID NO:553) according to the present invention is supported by 5 libraries. The number of libraries was determined as previously described. This segment can be found in the following transcript(s): HUMPHOSLIP_PEA_2_T19 (SEQ ID NO:57). Table 534 below describes the starting and ending position of this segment on each transcript.

TABLE 534

Segment location on transcripts

| Transcript name | Segment starting position | Segment ending position |
|---|---|---|
| HUMPHOSLIP_PEA_2_T19 (SEQ ID NO: 57) | 1558 | 1640 |

Segment cluster HUMPHOSLIP_PEA_2_node_54 (SEQ ID NO:554) according to the present invention is supported by 236 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 535 below describes the starting and ending position of this segment on each transcript.

TABLE 535

Segment location on transcripts

| Transcript name | Segment starting position | Segment ending position |
|---|---|---|
| HUMPHOSLIP_PEA_2_T6 (SEQ ID NO: 51) | 1512 | 1552 |
| HUMPHOSLIP_PEA_2_T7 (SEQ ID NO: 52) | 1650 | 1690 |
| HUMPHOSLIP_PEA_2_T14 (SEQ ID NO: 53) | 1643 | 1683 |
| HUMPHOSLIP_PEA_2_T16 (SEQ ID NO: 54) | 1551 | 1591 |
| HUMPHOSLIP_PEA_2_T17 (SEQ ID NO: 55) | 1273 | 1313 |
| HUMPHOSLIP_PEA_2_T18 (SEQ ID NO: 56) | 1487 | 1527 |
| HUMPHOSLIP_PEA_2_T19 (SEQ ID NO: 57) | 1641 | 1681 |

Segment cluster HUMPHOSLIP_PEA_2_node_55 (SEQ ID NO:555) according to the present invention is supported by 232 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 536 below describes the starting and ending position of this segment on each transcript.

TABLE 536

Segment location on transcripts

| Transcript name | Segment starting position | Segment ending position |
|---|---|---|
| HUMPHOSLIP_PEA_2_T6 (SEQ ID NO: 51) | 1553 | 1588 |
| HUMPHOSLIP_PEA_2_T7 (SEQ ID NO: 52) | 1691 | 1726 |
| HUMPHOSLIP_PEA_2_T14 (SEQ ID NO: 53) | 1684 | 1719 |
| HUMPHOSLIP_PEA_2_T16 (SEQ ID NO: 54) | 1592 | 1627 |
| HUMPHOSLIP_PEA_2_T17 (SEQ ID NO: 55) | 1314 | 1349 |
| HUMPHOSLIP_PEA_2_T18 (SEQ ID NO: 56) | 1528 | 1563 |
| HUMPHOSLIP_PEA_2_T19 (SEQ ID NO: 57) | 1682 | 1717 |

Segment cluster HUMPHOSLIP_PEA_2_node_58 (SEQ ID NO:556) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 537 below describes the starting and ending position of this segment on each transcript.

TABLE 537

Segment location on transcripts

| Transcript name | Segment starting position | Segment ending position |
|---|---|---|
| HUMPHOSLIP_PEA_2_T6 (SEQ ID NO: 51) | 1589 | 1612 |
| HUMPHOSLIP_PEA_2_T7 (SEQ ID NO: 52) | 1727 | 1750 |
| HUMPHOSLIP_PEA_2_T14 (SEQ ID NO: 53) | 1720 | 1743 |
| HUMPHOSLIP_PEA_2_T16 (SEQ ID NO: 54) | 1628 | 1651 |
| HUMPHOSLIP_PEA_2_T17 (SEQ ID NO: 55) | 1350 | 1373 |
| HUMPHOSLIP_PEA_2_T18 (SEQ ID NO: 56) | 1564 | 1587 |
| HUMPHOSLIP_PEA_2_T19 (SEQ ID NO: 57) | 1718 | 1741 |

Segment cluster HUMPHOSLIP_PEA_2_node_59 (SEQ ID NO:557) according to the present invention is supported by 230 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 538 below describes the starting and ending position of this segment on each transcript.

TABLE 538

Segment location on transcripts

| Transcript name | Segment starting position | Segment ending position |
|---|---|---|
| HUMPHOSLIP_PEA_2_T6 (SEQ ID NO: 51) | 1613 | 1648 |
| HUMPHOSLIP_PEA_2_T7 (SEQ ID NO: 52) | 1751 | 1786 |
| HUMPHOSLIP_PEA_2_T14 (SEQ ID NO: 53) | 1744 | 1779 |
| HUMPHOSLIP_PEA_2_T16 (SEQ ID NO: 54) | 1652 | 1687 |
| HUMPHOSLIP_PEA_2_T17 (SEQ ID NO: 55) | 1374 | 1409 |
| HUMPHOSLIP_PEA_2_T18 (SEQ ID NO: 56) | 1588 | 1623 |
| HUMPHOSLIP_PEA_2_T19 (SEQ ID NO: 57) | 1742 | 1777 |

Segment cluster HUMPHOSLIP_PEA_2_node_60 (SEQ ID NO:558) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 539 below describes the starting and ending position of this segment on each transcript.

TABLE 539

Segment location on transcripts

| Transcript name | Segment starting position | Segment ending position |
|---|---|---|
| HUMPHOSLIP_PEA_2_T6 (SEQ ID NO: 51) | 1649 | 1671 |
| HUMPHOSLIP_PEA_2_T7 (SEQ ID NO: 52) | 1787 | 1809 |
| HUMPHOSLIP_PEA_2_T14 (SEQ ID NO: 53) | 1780 | 1802 |
| HUMPHOSLIP_PEA_2_T16 (SEQ ID NO: 54) | 1688 | 1710 |
| HUMPHOSLIP_PEA_2_T17 (SEQ ID NO: 55) | 1410 | 1432 |
| HUMPHOSLIP_PEA_2_T18 (SEQ ID NO: 56) | 1624 | 1646 |
| HUMPHOSLIP_PEA_2_T19 (SEQ ID NO: 57) | 1778 | 1800 |

Segment cluster HUMPHOSLIP_PEA_2_node_61 (SEQ ID NO:559) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 540 below describes the starting and ending position of this segment on each transcript.

TABLE 540

Segment location on transcripts

| Transcript name | Segment starting position | Segment ending position |
|---|---|---|
| HUMPHOSLIP_PEA_2_T6 (SEQ ID NO: 51) | 1672 | 1680 |
| HUMPHOSLIP_PEA_2_T7 (SEQ ID NO: 52) | 1810 | 1818 |
| HUMPHOSLIP_PEA_2_T14 (SEQ ID NO: 53) | 1803 | 1811 |
| HUMPHOSLIP_PEA_2_T16 (SEQ ID NO: 54) | 1711 | 1719 |
| HUMPHOSLIP_PEA_2_T17 (SEQ ID NO: 55) | 1433 | 1441 |
| HUMPHOSLIP_PEA_2_T18 (SEQ ID NO: 56) | 1647 | 1655 |
| HUMPHOSLIP_PEA_2_T19 (SEQ ID NO: 57) | 1801 | 1809 |

Segment cluster HUMPHOSLIP_PEA_2_node_62 (SEQ ID NO:560) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 541 below describes the starting and ending position of this segment on each transcript.

TABLE 541

Segment location on transcripts

| Transcript name | Segment starting position | Segment ending position |
|---|---|---|
| HUMPHOSLIP_PEA_2_T6 (SEQ ID NO: 51) | 1681 | 1703 |
| HUMPHOSLIP_PEA_2_T7 (SEQ ID NO: 52) | 1819 | 1841 |
| HUMPHOSLIP_PEA_2_T14 (SEQ ID NO: 53) | 1812 | 1834 |
| HUMPHOSLIP_PEA_2_T16 (SEQ ID NO: 54) | 1720 | 1742 |
| HUMPHOSLIP_PEA_2_T17 (SEQ ID NO: 55) | 1442 | 1464 |
| HUMPHOSLIP_PEA_2_T18 (SEQ ID NO: 56) | 1656 | 1678 |
| HUMPHOSLIP_PEA_2_T19 (SEQ ID NO: 57) | 1810 | 1832 |

Segment cluster HUMPHOSLIP_PEA_2_node_63 (SEQ ID NO:561) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 542 below describes the starting and ending position of this segment on each transcript.

TABLE 542

Segment location on transcripts

| Transcript name | Segment starting position | Segment ending position |
|---|---|---|
| HUMPHOSLIP_PEA_2_T6 (SEQ ID NO: 51) | 1704 | 1727 |
| HUMPHOSLIP_PEA_2_T7 (SEQ ID NO: 52) | 1842 | 1865 |
| HUMPHOSLIP_PEA_2_T14 (SEQ ID NO: 53) | 1835 | 1858 |
| HUMPHOSLIP_PEA_2_T16 (SEQ ID NO: 54) | 1743 | 1766 |
| HUMPHOSLIP_PEA_2_T17 (SEQ ID NO: 55) | 1465 | 1488 |
| HUMPHOSLIP_PEA_2_T18 (SEQ ID NO: 56) | 1679 | 1702 |
| HUMPHOSLIP_PEA_2_T19 (SEQ ID NO: 57) | 1833 | 1856 |

Segment cluster HUMPHOSLIP_PEA_2_node_64 (SEQ ID NO:562) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 543 below describes the starting and ending position of this segment on each transcript.

TABLE 543

Segment location on transcripts

| Transcript name | Segment starting position | Segment ending position |
|---|---|---|
| HUMPHOSLIP_PEA_2_T6 (SEQ ID NO: 51) | 1728 | 1734 |
| HUMPHOSLIP_PEA_2_T7 (SEQ ID NO: 52) | 1866 | 1872 |
| HUMPHOSLIP_PEA_2_T14 (SEQ ID NO: 53) | 1859 | 1865 |
| HUMPHOSLIP_PEA_2_T16 (SEQ ID NO: 54) | 1767 | 1773 |
| HUMPHOSLIP_PEA_2_T17 (SEQ ID NO: 55) | 1489 | 1495 |
| HUMPHOSLIP_PEA_2_T18 (SEQ ID NO: 56) | 1703 | 1709 |
| HUMPHOSLIP_PEA_2_T19 (SEQ ID NO: 57) | 1857 | 1863 |

Segment cluster HUMPHOSLIP_PEA_2_node_65 (SEQ ID NO:563) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 544 below describes the starting and ending position of this segment on each transcript.

TABLE 544

Segment location on transcripts

| Transcript name | Segment starting position | Segment ending position |
|---|---|---|
| HUMPHOSLIP_PEA_2_T6 (SEQ ID NO: 51) | 1735 | 1754 |
| HUMPHOSLIP_PEA_2_T7 (SEQ ID NO: 52) | 1873 | 1892 |
| HUMPHOSLIP_PEA_2_T14 (SEQ ID NO: 53) | 1866 | 1885 |
| HUMPHOSLIP_PEA_2_T16 (SEQ ID NO: 54) | 1774 | 1793 |
| HUMPHOSLIP_PEA_2_T17 (SEQ ID NO: 55) | 1496 | 1515 |
| HUMPHOSLIP_PEA_2_T18 (SEQ ID NO: 56) | 1710 | 1729 |
| HUMPHOSLIP_PEA_2_T19 (SEQ ID NO: 57) | 1864 | 1883 |

Segment cluster HUMPHOSLIP_PEA_2_node_66 (SEQ ID NO:564) according to the present invention is supported by 180 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 545 below describes the starting and ending position of this segment on each transcript.

TABLE 545

Segment location on transcripts

| Transcript name | Segment starting position | Segment ending position |
|---|---|---|
| HUMPHOSLIP_PEA_2_T6 (SEQ ID NO: 51) | 1755 | 1844 |
| HUMPHOSLIP_PEA_2_T7 (SEQ ID NO: 52) | 1893 | 1982 |
| HUMPHOSLIP_PEA_2_T14 (SEQ ID NO: 53) | 1886 | 1975 |
| HUMPHOSLIP_PEA_2_T16 (SEQ ID NO: 54) | 1794 | 1883 |
| HUMPHOSLIP_PEA_2_T17 (SEQ ID NO: 55) | 1516 | 1605 |
| HUMPHOSLIP_PEA_2_T18 (SEQ ID NO: 56) | 1730 | 1819 |
| HUMPHOSLIP_PEA_2_T19 (SEQ ID NO: 57) | 1884 | 1973 |

Segment cluster HUMPHOSLIP_PEA_2_node_67 (SEQ ID NO:565) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 546 below describes the starting and ending position of this segment on each transcript.

TABLE 546

Segment location on transcripts

| Transcript name | Segment starting position | Segment ending position |
|---|---|---|
| HUMPHOSLIP_PEA_2_T6 (SEQ ID NO: 51) | 1845 | 1866 |
| HUMPHOSLIP_PEA_2_T7 (SEQ ID NO: 52) | 1983 | 2004 |
| HUMPHOSLIP_PEA_2_T14 (SEQ ID NO: 53) | 1976 | 1997 |
| HUMPHOSLIP_PEA_2_T16 (SEQ ID NO: 54) | 1884 | 1905 |
| HUMPHOSLIP_PEA_2_T17 (SEQ ID NO: 55) | 1606 | 1627 |
| HUMPHOSLIP_PEA_2_T18 (SEQ ID NO: 56) | 1820 | 1841 |
| HUMPHOSLIP_PEA_2_T19 (SEQ ID NO: 57) | 1974 | 1995 |

Segment cluster HUMPHOSLIP_PEA_2_node_69 (SEQ ID NO:566) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 547 below describes the starting and ending position of this segment on each transcript.

TABLE 547

Segment location on transcripts

| Transcript name | Segment starting position | Segment ending position |
|---|---|---|
| HUMPHOSLIP_PEA_2_T6 (SEQ ID NO: 51) | 2286 | 2297 |
| HUMPHOSLIP_PEA_2_T7 (SEQ ID NO: 52) | 2424 | 2435 |
| HUMPHOSLIP_PEA_2_T14 (SEQ ID NO: 53) | 2417 | 2428 |
| HUMPHOSLIP_PEA_2_T16 (SEQ ID NO: 54) | 2325 | 2336 |
| HUMPHOSLIP_PEA_2_T17 (SEQ ID NO: 55) | 2047 | 2058 |
| HUMPHOSLIP_PEA_2_T18 (SEQ ID NO: 56) | 2261 | 2272 |
| HUMPHOSLIP_PEA_2_T19 (SEQ ID NO: 57) | 2415 | 2426 |

Segment cluster HUMPHOSLIP_PEA_2_node_71 (SEQ ID NO:567) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 548 below describes the starting and ending position of this segment on each transcript.

TABLE 548

Segment location on transcripts

| Transcript name | Segment starting position | Segment ending position |
|---|---|---|
| HUMPHOSLIP_PEA_2_T6 (SEQ ID NO: 51) | 2530 | 2542 |
| HUMPHOSLIP_PEA_2_T7 (SEQ ID NO: 52) | 2668 | 2680 |
| HUMPHOSLIP_PEA_2_T14 (SEQ ID NO: 53) | 2661 | 2673 |
| HUMPHOSLIP_PEA_2_T16 (SEQ ID NO: 54) | 2569 | 2581 |
| HUMPHOSLIP_PEA_2_T17 (SEQ ID NO: 55) | 2291 | 2303 |
| HUMPHOSLIP_PEA_2_T18 (SEQ ID NO: 56) | 2505 | 2517 |
| HUMPHOSLIP_PEA_2_T19 (SEQ ID NO: 57) | 2659 | 2671 |

Segment cluster HUMPHOSLIP_PEA_2_node_72 (SEQ ID NO:568) according to the present invention is supported by 7 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 549 below describes the starting and ending position of this segment on each transcript.

TABLE 549

Segment location on transcripts

| Transcript name | Segment starting position | Segment ending position |
|---|---|---|
| HUMPHOSLIP_PEA_2_T6 (SEQ ID NO: 51) | 2543 | 2647 |
| HUMPHOSLIP_PEA_2_T7 (SEQ ID NO: 52) | 2681 | 2785 |
| HUMPHOSLIP_PEA_2_T14 (SEQ ID NO: 53) | 2674 | 2778 |
| HUMPHOSLIP_PEA_2_T16 (SEQ ID NO: 54) | 2582 | 2686 |
| HUMPHOSLIP_PEA_2_T17 (SEQ ID NO: 55) | 2304 | 2408 |
| HUMPHOSLIP_PEA_2_T18 (SEQ ID NO: 56) | 2518 | 2622 |
| HUMPHOSLIP_PEA_2_T19 (SEQ ID NO: 57) | 2672 | 2776 |

Segment cluster HUMPHOSLIP_PEA_2_node_73 (SEQ ID NO:569) according to the present invention is supported by 5 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 550 below describes the starting and ending position of this segment on each transcript.

TABLE 550

Segment location on transcripts

| Transcript name | Segment starting position | Segment ending position |
|---|---|---|
| HUMPHOSLIP_PEA_2_T6 (SEQ ID NO: 51) | 2648 | 2755 |
| HUMPHOSLIP_PEA_2_T7 (SEQ ID NO: 52) | 2786 | 2893 |
| HUMPHOSLIP_PEA_2_T14 (SEQ ID NO: 53) | 2779 | 2886 |
| HUMPHOSLIP_PEA_2_T16 (SEQ ID NO: 54) | 2687 | 2794 |
| HUMPHOSLIP_PEA_2_T17 (SEQ ID NO: 55) | 2409 | 2516 |
| HUMPHOSLIP_PEA_2_T18 (SEQ ID NO: 56) | 2623 | 2730 |
| HUMPHOSLIP_PEA_2_T19 (SEQ ID NO: 57) | 2777 | 2884 |

Segment cluster HUMPHOSLIP_PEA_2_node_74 (SEQ ID NO:570) according to the present invention is supported by 10 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 551 below describes the starting and ending position of this segment on each transcript.

TABLE 551

Segment location on transcripts

| Transcript name | Segment starting position | Segment ending position |
|---|---|---|
| HUMPHOSLIP_PEA_2_T6 (SEQ ID NO: 51) | 2756 | 2845 |
| HUMPHOSLIP_PEA_2_T7 (SEQ ID NO: 52) | 2894 | 2983 |
| HUMPHOSLIP_PEA_2_T14 (SEQ ID NO: 53) | 2887 | 2976 |
| HUMPHOSLIP_PEA_2_T16 (SEQ ID NO: 54) | 2795 | 2884 |
| HUMPHOSLIP_PEA_2_T17 (SEQ ID NO: 55) | 2517 | 2606 |
| HUMPHOSLIP_PEA_2_T18 (SEQ ID NO: 56) | 2731 | 2820 |
| HUMPHOSLIP_PEA_2_T19 (SEQ ID NO: 57) | 2885 | 2974 |

Variant Protein Alignment to the Previously Known Protein:

Sequence name: PLTP_HUMAN (SEQ ID NO:1433)

Sequence documentation:

Alignment of: HUMPHOSLIP_PEA_2_P10 (SEQ ID NO:1327) x PLTP_HUMAN (SEQ ID NO:1433) ..

Alignment segment 1/1:

| | | | |
|---|---|---|---|
| Quality: | 3716.00 | | |
| Escore: | 0 | | |
| Matching length: | 398 | Total length: | 493 |
| Matching Percent Similarity: | 100.00 | Matching Percent Identity: | 100.00 |
| Total Percent Similarity: | 80.73 | Total Percent Identity: | 80.73 |
| Gaps: | 1 | | |

Alignment:

```
  1   MALFGALFLALLAGAHAEFPGCKIRVTSKALELVKQEGLRFLEQELETIT    50
      ||||||||||||||||||||||||||||||||||||||||||||||||||
  1   MALFGALFLALLAGAHAEFPGCKIRVTSKALELVKQEGLRFLEQELETIT    50

51   IPDLRGKEGHFYYNISE.................................    67
      |||||||||||||||||
 51   IPDLRGKEGHFYYNISEVKVTELQLTSSELDFQPQQELMLQITNASLGLR   100

67   ..................................................    67

101   FRRQLLYWFFYDGGYINASAEGVSIRTGLELSRDPAGRMKVSNVSCQASV   150
```

```
 68 ...........KVYDFLSTFITSGMRFLLNQQICPVLYHAGTVLLNSLL  105
              ||||||||||||||||||||||||||||||||||||||
151 SRMHAAFGGTFKKVYDFLSTFITSGMRFLLNQQICPVLYHAGTVLLNSLL  200

106 DTVPVRSSVDELVGIDYSLMKDPVASTSNLDMDFRGAFFPLTERNWSLPN  155
    ||||||||||||||||||||||||||||||||||||||||||||||||||
201 DTVPVRSSVDELVGIDYSLMKDPVASTSNLDMDFRGAFFPLTERNWSLPN  250

156 RAVEPQLQEEERMVYVAFSEFFFDSAMESYFRAGALQLLLVGDKVPHDLD  205
    ||||||||||||||||||||||||||||||||||||||||||||||||||
251 RAVEPQLQEEERMVYVAFSEFFFDSAMESYFRAGALQLLLVGDKVPHDLD  300

206 MLLRATYFGSIVLLSPAVIDSPLKLELRVLAPPRCTIKPSGTTISVTASV  255
    ||||||||||||||||||||||||||||||||||||||||||||||||||
301 MLLRATYFGSIVLLSPAVIDSPLKLELRVLAPPRCTIKPSGTTISVTASV  350

256 TIALVPPDQPEVQLSSMTMDARLSAKMALRGKALRTQLDLRRFRIYSNHS  305
    ||||||||||||||||||||||||||||||||||||||||||||||||||
351 TIALVPPDQPEVQLSSMTMDARLSAKMALRGKALRTQLDLRRFRIYSNHS  400

306 ALESLALIPLQAPLKTMLQIGVMPMLNERTWRGVQIPLPEGINFVHEVVT  355
    ||||||||||||||||||||||||||||||||||||||||||||||||||
401 ALESLALIPLQAPLKTMLQIGVMPMLNERTWRGVQIPLPEGINFVHEVVT  450

356 NHAGFLTIGADLHFAKGLREVIEKNRPADVRASTAPTPSTAAV  398
    ||||||||||||||||||||||||||||||||||||||||||
451 NHAGFLTIGADLHFAKGLREVIEKNRPADVRASTAPTPSTAAV  493
```

Sequence name: PLTP_HUMAN (SEQ ID NO:1433)
Sequence documentation:
Alignment of: HUMPHOSLIP_PEA_2_P12 (SEQ ID NO:1328) x PLTP_HUMAN (SEQ ID NO:1433) ..
Alignment segment 1/1:

| | |
|---|---|
| Quality: | 4101.00 |
| Escore: | 0 |
| Matching length: | 427 |
| Total length: | 427 |
| Matching Percent Similarity: | 100.00 |
| Matching Percent Identity: | 100.00 |
| Total Percent Similarity: | 100.00 |
| Total Percent Identity: | 100.00 |
| Gaps: | 0 |

Alignment:

```
  1 MALFGALFLALLAGAHAEFPGCKIRVTSKALELVKQEGLRFLEQELETIT  50
    ||||||||||||||||||||||||||||||||||||||||||||||||||
  1 MALFGALFLALLAGAHAEFPGCKIRVTSKALELVKQEGLRFLEQELETIT  50

51 IPDLRGKEGHFYYNISEVKVTELQLTSSELDFQPQQELMLQITNASLGLR  100
    ||||||||||||||||||||||||||||||||||||||||||||||||||
 51 IPDLRGKEGHFYYNISEVKVTELQLTSSELDFQPQQELMLQITNASLGLR  100

101 FRRQLLYWFFYDGGYINASAEGVSIRTGLELSRDPAGRMKVSNVSCQASV  150
    ||||||||||||||||||||||||||||||||||||||||||||||||||
101 FRRQLLYWFFYDGGYINASAEGVSIRTGLELSRDPAGRMKVSNVSCQASV  150

151 SRMHAAFGGTFKKVYDFLSTFITSGMRFLLNQQICPVLYHAGTVLLNSLL  200
    ||||||||||||||||||||||||||||||||||||||||||||||||||
151 SRMHAAFGGTFKKVYDFLSTFITSGMRFLLNQQICPVLYHAGTVLLNSLL  200

201 DTVPVRSSVDELVGIDYSLMKDPVASTSNLDMDFRGAFFPLTERNWSLPN  250
    ||||||||||||||||||||||||||||||||||||||||||||||||||
201 DTVPVRSSVDELVGIDYSLMKDPVASTSNLDMDFRGAFFPLTERNWSLPN  250

251 RAVEPQLQEEERMVYVAFSEFFFDSAMESYFRAGALQLLLVGDKVPHDLD  300
    ||||||||||||||||||||||||||||||||||||||||||||||||||
251 RAVEPQLQEEERMVYVAFSEFFFDSAMESYFRAGALQLLLVGDKVPHDLD  300

301 MLLRATYFGSIVLLSPAVIDSPLKLELRVLAPPRCTIKPSGTTISVTASV  350
    ||||||||||||||||||||||||||||||||||||||||||||||||||
301 MLLRATYFGSIVLLSPAVIDSPLKLELRVLAPPRCTIKPSGTTISVTASV  350

351 TIALVPPDQPEVQLSSMTMDARLSAKMALRGKALRTQLDLRRFRIYSNHS  400
    ||||||||||||||||||||||||||||||||||||||||||||||||||
351 TIALVPPDQPEVQLSSMTMDARLSAKMALRGKALRTQLDLRRFRIYSNHS  400
```

-continued

```
401   ALESLALIPLQAPLKTMLQIGVMPMLN                              427
      |||||||||||||||||||||||||||
401   ALESLALIPLQAPLKTMLQIGVMPMLN                              427
```

Sequence name: PLTP_HUMAN (SEQ ID NO:1433)
Sequence documentation:
Alignment of: HUMPHOSLIP_PEA_2_P31 (SEQ ID NO:1330) x PLTP_HUMAN (SEQ ID NO:1433) ..
Alignment segment 1/1:

| | | | |
|---|---|---|---|
| Quality: | 639.00 | | |
| Escore: | 0 | | |
| Matching length: | 67 | Total length: | 67 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1    MALFGALFLALLAGAHAEFPGCKIRVTSKALELVKQEGLRFLEQELETIT        50
      |||||||||||||||||||||||||||||||||||||||||||||||||
 1    MALFGALFLALLAGAHAEFPGCKIRVTSKALELVKQEGLRFLEQELETIT        50

51    IPDLRGKEGHFYYNISE                                         67
      |||||||||||||||||
51    IPDLRGKEGHFYYNISE                                         67
```

Sequence name: PLTP_HUMAN (SEQ ID NO:1433)
Sequence documentation:
Alignment of: HUMPHOSLIP_PEA_2_P33 (SEQ ID NO:1331) x PLTP_HUMAN (SEQ ID NO:1433) ..
Alignment segment 1/1:

| | | | |
|---|---|---|---|
| Quality: | 1767.00 | | |
| Escore: | 0 | | |
| Matching length: | 184 | Total length: | 184 |
| Matching Percent Similarity: | 100.00 | Matching Percent Identity: | 99.46 |
| Total Percent Similarity: | 100.00 | Total Percent Identity: | 99.46 |
| Gaps: | 0 | | |

Alignment:

```
 1    MALFGALFLALLAGAHAEFPGCKIRVTSKALELVKQEGLRFLEQELETIT        50
      |||||||||||||||||||||||||||||||||||||||||||||||||
 1    MALFGALFLALLAGAHAEFPGCKIRVTSKALELVKQEGLRFLEQELETIT        50

51    IPDLRGKEGHFYYNISEVKVTELQLTSSELDFQPQQELMLQITNASLGLR        100
      |||||||||||||||||||||||||||||||||||||||||||||||||
51    IPDLRGKEGHFYYNISEVKVTELQLTSSELDFQPQQELMLQITNASLGLR        100

101   FRRQLLYWFFYDGGYINASAEGVSIRTGLELSRDPAGRMKVSNVSCQASV        150
      |||||||||||||||||||||||||||||||||||||||||||||||||
101   FRRQLLYWFFYDGGYINASAEGVSIRTGLELSRDPAGRMKVSNVSCQASV        150

151   SRMHAAFGGTFKKVYDFLSTFITSGMRFLLNQQV                        184
      |||||||||||||||||||||||||||||||||:
151   SRMHAAFGGTFKKVYDFLSTFITSGMRFLLNQQI                        184
```

Sequence name: PLTP_HUMAN (SEQ ID NO:1433)
Sequence documentation:
Alignment of: HUMPHOSLIP_PEA_2_P34 (SEQ ID NO:1332) x PLTP_HUMAN (SEQ ID NO:1433) ..
Alignment segment 1/1:

| | | | |
|---|---|---|---|
| Quality: | 1971.00 | | |
| Escore: | 0 | | |
| Matching length: | 205 | Total length: | 205 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MALFGALFLALLAGAHAEFPGCKIRVTSKALELVKQEGLRFLEQELETIT   50
    |||||||||||||||||||||||||||||||||||||||||||||||||
  1 MALFGALFLALLAGAHAEFPGCKIRVTSKALELVKQEGLRFLEQELETIT   50

51 IPDLRGKEGHFYYNISEVKVTELQLTSSELDFQPQQELMLQITNASLGLR  100
    |||||||||||||||||||||||||||||||||||||||||||||||||
 51 IPDLRGKEGHFYYNISEVKVTELQLTSSELDFQPQQELMLQITNASLGLR  100

101 FRRQLLYWFFYDGGYINASAEGVSIRTGLELSRDPAGRMKVSNVSCQASV  150
    |||||||||||||||||||||||||||||||||||||||||||||||||
101 FRRQLLYWFFYDGGYINASAEGVSIRTGLELSRDPAGRMKVSNVSCQASV  150

151 SRMHAAFGGTFKKVYDFLSTFITSGMRFLLNQQICPVLYHAGTVLLNSLL  200
    |||||||||||||||||||||||||||||||||||||||||||||||||
151 SRMHAAFGGTFKKVYDFLSTFITSGMRFLLNQQICPVLYHAGTVLLNSLL  200

201 DTVPV                                               205
    |||||
201 DTVPV                                               205
```

Sequence name: PLTP_HUMAN (SEQ ID NO:1433)
Sequence documentation:

Alignment of: HUMPHOSLIP_PEA_2_P35 (SEQ ID NO:1333) x PLTP_HUMAN (SEQ ID NO:1433) ..

Alignment segment 1/1:

| | | | |
|---|---|---|---|
| Quality: | 1158.00 | | |
| Escore: | 0 | | |
| Matching length: | 132 | Total length: | 184 |
| Matching Percent Similarity: | 100.00 | Matching Percent Identity: | 98.48 |
| Total Percent Similarity: | 71.74 | Total Percent Identity: | 70.65 |
| Gaps: | 1 | | |

Alignment:

```
  1 MALFGALFLALLAGAHAEFPGCKIRVTSKALELVKQEGLRFLEQELETIT   50
    |||||||||||||||||||||||||||||||||||||||||||||||||
  1 MALFGALFLALLAGAHAEFPGCKIRVTSKALELVKQEGLRFLEQELETIT   50

51 IPDLRGKEGHFYYNISEVKVTELQLTSSELDFQPQQELMLQITNASLGLR  100
    |||||||||||||||||||||||||||||||||||||||||||||||||
 51 IPDLRGKEGHFYYNISEVKVTELQLTSSELDFQPQQELMLQITNASLGLR  100

101 FRRQLLYWFL........................................  110
    ||||||||||:
101 FRRQLLYWFFYDGGYINASAEGVSIRTGLELSRDPAGRMKVSNVSCQASV  150

111 ............KVYDFLSTFITSGMRFLLNQQV                  132
                |||||||||||||||||||||||:
151 SRMHAAFGGTFKKVYDFLSTFITSGMRFLLNQQI                  184
```

Description for Cluster AI076020

Cluster AI076020 features 1 transcript(s) and 8 segment(s) of interest, the names for which are given in Tables 552 and 553, respectively, the sequences themselves are given at the end of the application. The selected protein variants are given in table 554.

TABLE 552

| Transcripts of interest | |
|---|---|
| Transcript Name | Sequence ID No. |
| AI076020_T0 | 58 |

TABLE 553

| Segments of interest | |
|---|---|
| Segment Name | Sequence ID No. |
| AI076020_node_0 | 571 |
| AI076020_node_3 | 572 |
| AI076020_node_8 | 573 |
| AI076020_node_1 | 574 |

TABLE 553-continued

| Segments of interest | |
|---|---|
| Segment Name | Sequence ID No. |
| AI076020_node_4 | 575 |
| AI076020_node_5 | 576 |
| AI076020_node_6 | 577 |
| AI076020_node_7 | 578 |

TABLE 553-continued

Segments of interest

| Segment Name | Sequence ID No. |
|---|---|

TABLE 554

Proteins of interest

| Protein Name | Sequence ID No. | Corresponding Transcript(s) |
|---|---|---|
| AI076020_P1 | 1334 | AI076020_T0 (SEQ ID NO: 58) |

These sequences are variants of the known protein C1q-related factor precursor (SwissProt accession identifier C1RF_HUMAN), SEQ ID NO: 1434, referred to herein as the previously known protein.

The sequence for protein C1q-related factor precursor (SEQ ID NO:1434) is given at the end of the application, as "C1q-related factor precursor amino acid sequence".

The following GO Annotation(s) apply to the previously known protein. The following annotation(s) were found: locomotory behavior, which are annotation(s) related to Biological Process.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster AI076020 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 31 refer to weighted expression of ESTs in each category, as "parts per million" (ratio of the expression of ESTs for a particular cluster to the expression of all ESTs in that category, according to parts per million).

Figure 31:
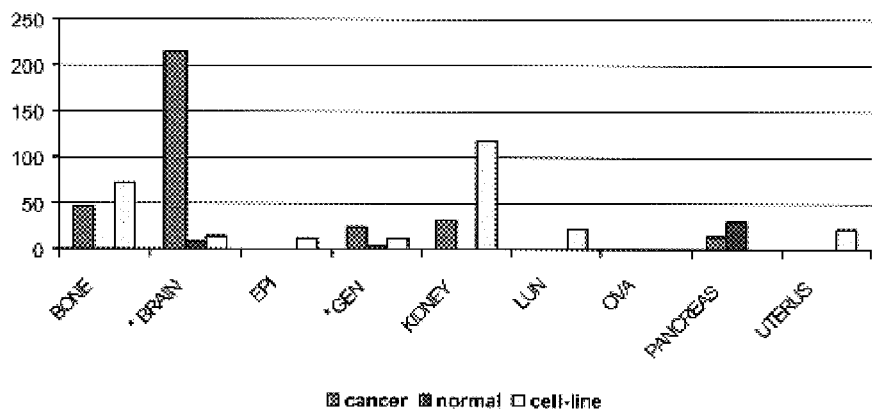
FIG. 31 is a histogram showing Cancer and cell-line vs. normal tissue expression for Cluster AA161187, demonstrating overexpression in brain malignant tumors and a mixture of malignant tumors from different tissues.

Overall, the following results were obtained as shown with regard to the histograms in FIG. 31 and Table 555. This cluster is overexpressed (at least at a minimum level) in the following pathological conditions: brain malignant tumors and a mixture of malignant tumors from different tissues.

TABLE 555

Normal tissue distribution

| Name of Tissue | Number |
|---|---|
| bone | 0 |
| brain | 9 |
| epithelial | 0 |
| general | 4 |
| kidney | 2 |
| lung | 0 |
| ovary | 0 |
| pancreas | 30 |
| uterus | 0 |

TABLE 556

P values and ratios for expression in cancerous tissue

| Name of Tissue | P1 | P2 | SP1 | R3 | SP2 | R4 |
|---|---|---|---|---|---|---|
| bone | 3.3e−01 | 5.9e−02 | 4.0e−01 | 2.5 | 2.4e−01 | 3.0 |
| brain | 8.8e−04 | 2.2e−03 | 5.5e−11 | 14.2 | 4.6e−08 | 8.7 |
| epithelial | 2.6e−01 | 8.6e−02 | 2.8e−01 | 2.4 | 1.8e−02 | 4.5 |
| general | 2.1e−03 | 3.0e−04 | 2.0e−06 | 4.3 | 8.4e−06 | 3.5 |
| kidney | 5.5e−01 | 3.3e−01 | 3.4e−01 | 2.3 | 8.2e−02 | 3.3 |
| lung | 1 | 6.3e−01 | 1 | 1.0 | 3.8e−01 | 2.2 |
| ovary | 4.2e−01 | 4.5e−01 | 0.0e+00 | 0.0 | 0.0e+00 | 0.0 |
| pancreas | 6.0e−01 | 7.1e−01 | 8.9e−01 | 0.6 | 9.5e−01 | 0.5 |
| uterus | 1 | 4.0e−01 | 1 | 1.0 | 6.4e−01 | 1.5 |

As noted above, cluster AI076020 features 1 transcript(s), which were listed in Table 1 above. These transcript(s) encode for protein(s) which are variant(s) of protein C1q-related factor precursor (SEQ ID NO:1434). A description of each variant protein according to the present invention is now provided.

Variant protein AI076020_P1 (SEQ ID NO:1334) according to the present invention has an amino acid sequence as given at the end of the application; it is encoded by transcript(s) AI076020_T0 (SEQ ID NO:58). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AI076020_P1 (SEQ ID NO:1334) also has the following non-silent SNPs (Single Nucleotide Polymorphisms) as listed in Table 557, (given according to their position(s) on the amino acid sequence, with the alternative amino acid(s) listed; the last column indicates whether the SNP is known or not; the presence of known SNPs in variant protein AI076020_P1 (SEQ ID NO:1334) sequence provides support for the deduced sequence of this variant protein according to the present invention).

TABLE 557

Amino acid mutations

| SNP position(s) on amino acid sequence | Alternative amino acid(s) | Previously known SNP? |
|---|---|---|
| 36 | P -> R | Yes |
| 66 | Q -> R | Yes |
| 165 | K -> R | Yes |

Variant protein AI076020_P1 (SEQ ID NO:1334) is encoded by the following transcript(s): AI076020_T0 (SEQ ID NO:58), for which the sequence(s) is/are given at the end of the application. The coding portion of transcript AI076020_T0 (SEQ ID NO:58) is shown in bold; this coding portion starts at position 261 and ends at position 1034. The transcript also has the following SNPs as listed in Table 558 (given according to their position on the nucleotide sequence, with the alternative nucleic acid listed; the last column indicates whether the SNP is known or not; the presence of known SNPs in variant protein AI076020_P1 (SEQ ID NO:1334) sequence provides support for the deduced sequence of this variant protein according to the present invention).

TABLE 558

Nucleic acid SNPs

| SNP position on nucleotide sequence | Alternative nucleic acid | Previously known SNP? |
|---|---|---|
| 367 | C -> G | Yes |
| 457 | A -> G | Yes |
| 464 | C -> A | Yes |
| 754 | A -> G | Yes |
| 1265 | C -> T | Yes |
| 1384 | C -> T | Yes |
| 1402 | G -> C | Yes |
| 1452 | T -> C | Yes |

As noted above, cluster AI076020 features 8 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster AI076020_node_0 (SEQ ID NO:571) according to the present invention is supported by 28 libraries. The number of libraries was determined as previously described. This segment can be found in the following transcript(s): AI076020_T0 (SEQ ID NO:58). Table 559 below describes the starting and ending position of this segment on each transcript.

TABLE 559

Segment location on transcripts

| Transcript name | Segment starting position | Segment ending position |
|---|---|---|
| AI076020_T0 (SEQ ID NO: 58) | 1 | 774 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 560.

TABLE 560

Oligonucleotides related to this segment

| Oligonucleotide name | Overexpressed in cancers | Chip reference |
|---|---|---|
| AI076020_0_3_0 | lung malignant tumors | LUN |

Segment cluster AI076020_node_3 (SEQ ID NO:572) according to the present invention is supported by 30 libraries. The number of libraries was determined as previously described. This segment can be found in the following transcript(s): AI076020_T0 (SEQ ID NO:58). Table 561 below describes the starting and ending position of this segment on each transcript.

TABLE 561

Segment location on transcripts

| Transcript name | Segment starting position | Segment ending position |
|---|---|---|
| AI076020_T0 (SEQ ID NO: 58) | 858 | 1027 |

Segment cluster AI076020_node_8 (SEQ ID NO:573) according to the present invention is supported by 35 libraries. The number of libraries was determined as previously described. This segment can be found in the following transcript(s): AI076020_T0 (SEQ ID NO:58). Table 562 below describes the starting and ending position of this segment on each transcript.

TABLE 562

Segment location on transcripts

| Transcript name | Segment starting position | Segment ending position |
|---|---|---|
| AI076020_T0 (SEQ ID NO:58) | 1359 | 1533 |

According to an optional embodiment of the present invention, short segments related to the above cluster are also provided. These segments are up to about 120 bp in length, and so are included in a separate description.

Segment cluster AI076020_node_1 (SEQ ID NO:574) according to the present invention is supported by 19 libraries. The number of libraries was determined as previously described. This segment can be found in the following transcript(s): AI076020_T0 (SEQ ID NO:58). Table 563 below describes the starting and ending position of this segment on each transcript.

TABLE 563

Segment location on transcripts

| Transcript name | Segment starting position | Segment ending position |
|---|---|---|
| AI076020_T0 (SEQ ID NO:58) | 775 | 857 |

Segment cluster AI076020_node_4 (SEQ ID NO:575) according to the present invention is supported by 28 libraries. The number of libraries was determined as previously described. This segment can be found in the following transcript(s): AI076020_T0 (SEQ ID NO:58). Table 564 below describes the starting and ending position of this segment on each transcript.

TABLE 564

Segment location on transcripts

| Transcript name | Segment starting position | Segment ending position |
|---|---|---|
| AI076020_T0 (SEQ ID NO:58) | 1028 | 1129 |

Segment cluster AI076020_node_5 (SEQ ID NO:576) according to the present invention is supported by 31 libraries. The number of libraries was determined as previously described. This segment can be found in the following transcript(s): AI076020_T0 (SEQ ID NO:58). Table 565 below describes the starting and ending position of this segment on each transcript.

TABLE 565

Segment location on transcripts

| Transcript name | Segment starting position | Segment ending position |
|---|---|---|
| AI076020_T0 (SEQ ID NO:58) | 1130 | 1244 |

Segment cluster AI076020_node_6 (SEQ ID NO:577) according to the present invention is supported by 32 libraries. The number of libraries was determined as previously described. This segment can be found in the following transcript(s): AI076020_T0 (SEQ ID NO:58). Table 566 below describes the starting and ending position of this segment on each transcript.

TABLE 566

Segment location on transcripts

| Transcript name | Segment starting position | Segment ending position |
|---|---|---|
| AI076020_T0 (SEQ ID NO:58) | 1245 | 1320 |

Segment cluster AI076020_node_7 (SEQ ID NO:578) according to the present invention is supported by 33 libraries. The number of libraries was determined as previously described. This segment can be found in the following transcript(s): AI076020_T0 (SEQ ID NO:58). Table 567 below describes the starting and ending position of this segment on each transcript.

TABLE 567

Segment location on transcripts

| Transcript name | Segment starting position | Segment ending position |
|---|---|---|
| AI076020_T0 (SEQ ID NO:58) | 1321 | 1358 |

Description for Cluster T23580

Cluster T23580 features 1 transcript(s) and 5 segment(s) of interest, the names for which are given in Tables 568 and 569, respectively, the sequences themselves are given at the end of the application. The selected protein variants are given in table 570.

TABLE 568

Transcripts of interest

| Transcript Name | Sequence ID No. |
|---|---|
| T23580_T10 | 1626 |

TABLE 569

Segments of interest

| Segment Name | Sequence ID No. |
|---|---|
| T23580_node_17 | 579 |
| T23580_node_18 | 580 |
| T23580_node_21 | 581 |
| T23580_node_19 | 582 |
| T23580_node_20 | 583 |

TABLE 570

Proteins of interest

| Protein Name | Sequence ID No. | Corresponding Transcript(s) |
|---|---|---|
| T23580_P5 | 1335 | T23580_T10 (SEQ ID NO:1626) |

These sequences are variants of the known protein Neuronal protein NP25 (SwissProt accession identifier TAG3_HUMAN; known also according to the synonyms Neuronal protein 22; NP22; Transgelin-3), SEQ ID NO:1435, referred to herein as the previously known protein and also as NP25_HUMAN, which is the former SwissProt accession identifier.

The sequence for protein Neuronal protein NP25 (SEQ ID NO:1435) is given at the end of the application, as "Neuronal protein NP25 amino acid sequence".

The following GO Annotation(s) apply to the previously known protein. The following annotation(s) were found: central nervous system development, which are annotation(s) related to Biological Process.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 571, with regard to lung cancer.

TABLE 571

Oligonucleotides related to this cluster

| Oligonucleotide name | Overexpressed in cancers | Chip reference |
|---|---|---|
| T23580_0_0_902 | lung malignant tumors | LUN |

As noted above, cluster T23580 features 1 transcript(s), which were listed in Table 1 above. These transcript(s) encode for protein(s) which are variant(s) of protein Neuronal protein NP25 (SEQ ID NO:1435). A description of each variant protein according to the present invention is now provided.

Variant protein T23580_P5 (SEQ ID NO:1335) according to the present invention has an amino acid sequence as given at the end of the application; it is encoded by transcript(s) T23580_T10 (SEQ ID NO:1626). The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM: Signal peptide,NN:NO) predicts that this protein has a signal peptide.

Variant protein T23580_P5 (SEQ ID NO:1335) also has the following non-silent SNPs (Single Nucleotide Polymorphisms) as listed in Table 572, (given according to their position(s) on the amino acid sequence, with the alternative amino acid(s) listed; the last column indicates whether the SNP is known or not; the presence of known SNPs in variant protein T23580_P5 (SEQ ID NO:1335) sequence provides support for the deduced sequence of this variant protein according to the present invention).

TABLE 572

Amino acid mutations

| SNP position(s) on amino acid sequence | Alternative amino acid(s) | Previously known SNP? |
|---|---|---|
| 129 | V -> I | Yes |

Variant protein T23580_P5 (SEQ ID NO:1335) is encoded by the following transcript(s): T23580_T10 (SEQ ID NO:1626), for which the sequence(s) is/are given at the end of the application. The coding portion of transcript T23580_T10 (SEQ ID NO:1626) is shown in bold; this coding portion starts at position 1066 and ends at position 1485. The transcript also has the following SNPs as listed in Table 573 (given according to their position on the nucleotide sequence, with the alternative nucleic acid listed; the last column indicates whether the SNP is known or not; the presence of known SNPs in variant protein T23580_P5 (SEQ ID NO:1335) sequence provides support for the deduced sequence of this variant protein according to the present invention).

TABLE 573

Nucleic acid SNPs

| SNP position on nucleotide sequence | Alternative nucleic acid | Previously known SNP? |
|---|---|---|
| 37 | A -> C | Yes |
| 320 | G -> A | Yes |
| 371 | G -> T | Yes |
| 372 | G -> A | Yes |
| 441 | A -> G | Yes |
| 699 | G -> C | Yes |
| 744 | C -> G | Yes |
| 862 | G -> T | Yes |
| 1450 | G -> A | Yes |

As noted above, cluster T23580 features 5 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T23580_node__17 (SEQ ID NO:579) according to the present invention is supported by 10 libraries. The number of libraries was determined as previously described. This segment can be found in the following transcript(s): T23580_T10 (SEQ ID NO:1626). Table 574 below describes the starting and ending position of this segment on each transcript.

TABLE 574

Segment location on transcripts

| Transcript name | Segment starting position | Segment ending position |
|---|---|---|
| T23580_T10 (SEQ ID NO:1626) | 1 | 1098 |

Segment cluster T23580_node__18 (SEQ ID NO:580) according to the present invention is supported by 102 libraries. The number of libraries was determined as previously described. This segment can be found in the following transcript(s): T23580_T10 (SEQ ID NO:1626). Table 575 below describes the starting and ending position of this segment on each transcript.

TABLE 575

Segment location on transcripts

| Transcript name | Segment starting position | Segment ending position |
|---|---|---|
| T23580_T10 (SEQ ID NO:1626) | 1099 | 1357 |

Segment cluster T23580_node__21 (SEQ ID NO:581) according to the present invention is supported by 79 libraries. The number of libraries was determined as previously described. This segment can be found in the following transcript(s): T23580_T10 (SEQ ID NO:1626). Table 576 below describes the starting and ending position of this segment on each transcript.

TABLE 576

Segment location on transcripts

| Transcript name | Segment starting position | Segment ending position |
|---|---|---|
| T23580_T10 (SEQ ID NO:1626) | 1382 | 1582 |

According to an optional embodiment of the present invention, short segments related to the above cluster are also provided. These segments are up to about 120 bp in length, and so are included in a separate description.

Segment cluster T23580_node__19 (SEQ ID NO:582) according to the present invention can be found in the following transcript(s): T23580_T10 (SEQ ID NO:1626). Table 577 below describes the starting and ending position of this segment on each transcript.

TABLE 577

Segment location on transcripts

| Transcript name | Segment starting position | Segment ending position |
|---|---|---|
| T23580_T10 (SEQ ID NO:1626) | 1358 | 1370 |

Segment cluster T23580_node__20 (SEQ ID NO:583) according to the present invention can be found in the following transcript(s): T23580_T10 (SEQ ID NO:1626). Table 578 below describes the starting and ending position of this segment on each transcript.

TABLE 578

Segment location on transcripts

| Transcript name | Segment starting position | Segment ending position |
|---|---|---|
| T23580_T10 (SEQ ID NO:1626) | 1371 | 1381 |

Description for Cluster M79217

Cluster M79217 features 6 transcript(s) and 32 segment(s) of interest, the names for which are given in Tables 579 and 580, respectively, the sequences themselves are given at the end of the application. The selected protein variants are given in table 581.

TABLE 579

Transcripts of interest

| Transcript Name | Sequence ID No. |
|---|---|
| M79217_PEA_1_T1 | 59 |
| M79217_PEA_1_T3 | 60 |
| M79217_PEA_1_T8 | 61 |
| M79217_PEA_1_T10 | 62 |
| M79217_PEA_1_T15 | 63 |
| M79217_PEA_1_T18 | 64 |

TABLE 580

Segments of interest

| Segment Name | Sequence ID No. |
|---|---|
| M79217_PEA_1_node_2 | 584 |
| M79217_PEA_1_node_4 | 585 |
| M79217_PEA_1_node_9 | 586 |
| M79217_PEA_1_node_10 | 587 |
| M79217_PEA_1_node_11 | 588 |
| M79217_PEA_1_node_13 | 589 |
| M79217_PEA_1_node_14 | 590 |
| M79217_PEA_1_node_16 | 591 |
| M79217_PEA_1_node_23 | 592 |
| M79217_PEA_1_node_24 | 593 |
| M79217_PEA_1_node_31 | 594 |
| M79217_PEA_1_node_33 | 595 |
| M79217_PEA_1_node_34 | 596 |
| M79217_PEA_1_node_35 | 597 |
| M79217_PEA_1_node_37 | 598 |
| M79217_PEA_1_node_38 | 599 |
| M79217_PEA_1_node_41 | 600 |
| M79217_PEA_1_node_44 | 601 |
| M79217_PEA_1_node_0 | 602 |
| M79217_PEA_1_node_7 | 603 |
| M79217_PEA_1_node_12 | 604 |
| M79217_PEA_1_node_19 | 605 |
| M79217_PEA_1_node_21 | 606 |
| M79217_PEA_1_node_26 | 607 |
| M79217_PEA_1_node_27 | 608 |
| M79217_PEA_1_node_30 | 609 |
| M79217_PEA_1_node_32 | 610 |
| M79217_PEA_1_node_36 | 611 |
| M79217_PEA_1_node_39 | 612 |
| M79217_PEA_1_node_40 | 613 |
| M79217_PEA_1_node_42 | 614 |
| M79217_PEA_1_node_43 | 615 |

TABLE 581

Proteins of interest

| Protein Name | Sequence ID No. | Corresponding Transcript(s) |
|---|---|---|
| M79217_PEA_1_P1 | 1336 | M79217_PEA_1_T1 (SEQ ID NO:59); M79217_PEA_1_T3 (SEQ ID NO:60) |
| M79217_PEA_1_P2 | 1337 | M79217_PEA_1_T8 (SEQ ID NO:61) |
| M79217_PEA_1_P4 | 1338 | M79217_PEA_1_T10 (SEQ ID NO:62) |
| M79217_PEA_1_P8 | 1339 | M79217_PEA_1_T15 (SEQ ID NO:63) |
| M79217_PEA_1_P11 | 1340 | M79217_PEA_1_T18 (SEQ ID NO:64) |

These sequences are variants of the known protein Exostosin-like 3 (SwissProt accession identifier EXL3_HUMAN; known also according to the synonyms EC 2.4.1.223; Glucuronyl-galactosyl-proteoglycan 4-alpha-N-acetylglucosaminyltransferase; Putative tumor suppressor protein EXTL3; Multiple exostosis-like protein 3; Hereditary multiple exostoses gene isolog; EXT-related protein 1), SEQ ID NO:1436, referred to herein as the previously known protein.

Protein Exostosin-like 3 (SEQ ID NO:1436) is known or believed to have the following function(s): Probable glycosyltransferase (By similarity). The sequence for protein Exostosin-like 3 is given at the end of the application, as "Exostosin-like 3 amino acid sequence". Protein Exostosin-like 3 localization is believed to be Type II membrane protein. Endoplasmic reticulum.

The following GO Annotation(s) apply to the previously known protein. The following annotation(s) were found: cell growth and/or maintenance, which are annotation(s) related to Biological Process; transferase, transferring glycosyl groups, which are annotation(s) related to Molecular Function; and endoplasmic reticulum; integral membrane protein, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

As noted above, cluster M79217 features 6 transcript(s), which were listed in Table 1 above. These transcript(s) encode for protein(s) which are variant(s) of protein Exostosin-like 3 (SEQ ID NO:1436). A description of each variant protein according to the present invention is now provided.

Variant protein M79217_PEA_1_P1 (SEQ ID NO:1336) according to the present invention has an amino acid sequence as given at the end of the application; it is encoded by transcript(s) M79217_PEA_1_T1 (SEQ ID NO:59). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison Report Between M79217_PEA_1_P1 (SEQ ID NO:1336) and BAA25445 (SEQ ID NO:1437):

1. An isolated chimeric polypeptide encoding for M79217_PEA_1_P1 (SEQ ID NO:1336), comprising a first amino acid sequence being at least 90% homologous to MTGYTMLRNGGAGNGGQTCMLRWSNR- IRLTWLSFTLFVILVFFPLIAHYYLTTLDEAD
EAGKRIFGPRVGNELCEVKHVLDLCR-
IRESVSEELLQLEAKRQELNSEIAKLNLKIEACK
KSIENAKQDLLQLKNVISQTEHSYKEL-
MAQNQPKLSLPIRLLPEKDDAGLPPPKATRGC
RLHNCFDYSRCPLTSGFPVYVYDS-
DQFVFGSYLDPLVKQAFQATARANVYVTENADIA
CLYVILVGEMQEPVVLRPAELEKQLYSL-
PHWRTDGHNHVIINLSRKSDTQNLLYNVSTG RAM-
VAQSTFYTVQYRPGFDLVVSPLVHAM-
SEPNFMEIPPQVPVKRKYLFTFQGEKIESL
RSSLQEARSFEEEMEGDPPADYDDRII-
ATLKAVQDSKLDQVLVEFTCKNQPKPSLPTEW
ALCGEREDRLELLKLSTFALIITPGD-
PRLVISSGCATRLFEALEVGAVPVVLGEQVQLPY
QDMLQWNEAALVVPKPRVTEVHFLL-
RSLSDSDLLAMRRQGRFLWETYFSTADSIFNTV
LAMIRTRIQIPAAPIREEAAAEIPHRSG-
KAAGTDPNMADNGDLDLGPVETEPPYASPRYL
RNFTLTVTDFYRSWNCAPGPFHLFPHT-
PFDPVLPSEAKFLGSGTGFRPIGGGAGGSGKEF
QAALGGNVPREQFTVVMLTYEREEV-
LMNSLERLNGLPYLNKVVVVWNSPKLPSEDLL
WPDIGVPIMVVRTEKNSLNNRFLPWNEI-
ETEAILSIDDDAHLRHDEIMFGFRVWREARD RIVGF-
PGRYHAWDIPHQSWLYNSNYSCELSMV-
LTGAAFFHKYYAYLYSYVMPQAIRD
MVDEYINCEDIAMNFLVSHITRKP-
PIKVTSRWTFRCPGCPQALSHDDSHFHERHKCINFF
VKVYGYMPLLYTQFRVDSVLFKTRLPHDKTKCFKFI
corresponding to amino acids 13-931 of BAA25445 (SEQ ID NO:1437), which also corresponds to amino acids 1-919 of M79217_PEA__1_P1 (SEQ ID NO:1336).

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein M79217_PEA__1_P1 (SEQ ID NO:1336) is encoded by the following transcript(s): M79217_PEA__1_T1 (SEQ ID NO:59), for which the sequence(s) is/are given at the end of the application. The coding portion of transcript M79217_PEA__1_T1 (SEQ ID NO:59) is shown in bold; this coding portion starts at position 1074 and ends at position 3830. The transcript also has the following SNPs as listed in Table 582 (given according to their position on the nucleotide sequence, with the alternative nucleic acid listed; the last column indicates whether the SNP is known or not; the presence of known SNPs in variant protein M79217_PEA__1_P1 (SEQ ID NO:1336) sequence provides support for the deduced sequence of this variant protein according to the present invention).

TABLE 582

Nucleic acid SNPs

| SNP position on nucleotide sequence | Alternative nucleic acid | Previously known SNP? |
|---|---|---|
| 1014 | C -> T | No |
| 1015 | T -> | No |
| 1072 | T -> C | No |
| 1232 | T -> A | No |
| 1383 | A -> G | No |

TABLE 582-continued

Nucleic acid SNPs

| SNP position on nucleotide sequence | Alternative nucleic acid | Previously known SNP? |
|---|---|---|
| 1440 | A -> G | No |
| 1544 | C -> | No |
| 1546 | G -> A | No |
| 1685 | T -> G | No |
| 2215 | C -> | No |
| 2300 | A -> G | Yes |
| 2483 | T -> C | No |
| 2518 | C -> | No |
| 2632 | T -> G | No |
| 3190 | T -> C | Yes |
| 3352 | T -> C | No |
| 3373 | G -> T | No |
| 3386 | C -> | No |
| 3449 | C -> T | Yes |
| 3618 | A -> G | No |
| 3733 | A -> G | No |
| 4021 | C -> | No |
| 4021 | C -> T | No |
| 4086 | G -> A | No |
| 4087 | G -> A | No |
| 4416 | T -> A | No |
| 4586 | G -> A | Yes |
| 4772 | C -> T | No |
| 5110 | C -> T | Yes |
| 5219 | C -> T | Yes |
| 5437 | G -> A | No |
| 5645 | G -> A | No |
| 5743 | G -> A | Yes |
| 5887 | G -> T | Yes |
| 6143 | A -> C | No |
| 6277 | G -> | No |
| 6277 | G -> C | No |
| 6295 | C -> G | Yes |
| 6308 | T -> A | No |
| 6403 | G -> A | Yes |
| 6442 | G -> | No |
| 6495 | C -> T | No |

Variant protein M79217_PEA__1_P2 (SEQ ID NO:1337) according to the present invention has an amino acid sequence as given at the end of the application; it is encoded by transcript(s) M79217_PEA__1_T8 (SEQ ID NO:61). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison Report Between M79217_PEA__1_P2 (SEQ ID NO:1337) and EXL3_HUMAN (SEQ ID NO:1436):

1. An isolated chimeric polypeptide encoding for M79217_PEA__1_P2 (SEQ ID NO:1337), comprising a first amino acid sequence being at least 90% homologous to
MTGYTMLRNGGAGNGGQTCMLRWSNR-
IRLTWLSFTLFVILVFFPLIAHYYLTTLDEAD
EAGKRIFGPRVGNELCEVKHVLDLCR-
IRESVSEELLQLEAKRQELNSEIAKLNLKIEACK
KSIENAKQDLLQLKNVISQTEHSYKEL-
MAQNQPKLSLPIRLLPEKDDAGLPPPKATRGC
RLHNCFDYSRCPLTSGFPVYVYDS-
DQFVFGSYLDPLVKQAFQATARANVYVTENADIA
CLYVILVGEMQEPVVLRPAELEKQLYSL-
PHWRTDGHNHVIINLSRKSDTQNLLYNVSTG RAM-
VAQSTFYTVQYRPGFDLVVSPLVHAM-
SEPNFMEIPPQVPVKRKYLFTFQGEKIESL
RSSLQEARSFEEEMEGDPPADYDDRII- ATLKAVQDSKLDQVLVEFTCKNQPKPSLPTEW ALCGEREDRLELLKLSTFALIITPGD-PRLVISSGCATRLFEALEVGAVPVVLGEQVQLPY QDMLQWNEAALVVPKPRVTEVHFLL-RSLSDSDLLAMRRQGRFLWETYFSTADSIFNTV LAMIRTRIQIPAAPIREEAAAEIPHRSG-KAAGTDPNMADNGDLDLGPVETEPPYASPRYL RNFTLTVTDFYRSWNCAPGPFHLFPHT-PFDPVLPSEAKFLGSGTGFRPIGGGAGGSGKEF QAALGGNVPREQFTVVMLTYEREEV-LMNSLERLNGLPYLNKVVVVWNSPKLPSEDLL WPDIGVPIMVVRTEKNSLNNRFLPWNEI-ETEAILSIDDDAHLRHDEIMFGFRVWREARD RIVGF-PGRYHAWDIPHQSWLYNSNYSCELSMVLTGAAFFHK corresponding to amino acids 1-807 of EXL3_HUMAN (SEQ ID NO:1436), which also corresponds to amino acids 1-807 of M79217_PEA__1_P2 (SEQ ID NO:1337), and a second amino acid sequence being at least 90% homologous to AIRDMVDEYINCEDIAMNFLVSHITRKP-PIKVTSRWTFRCPGCPQALSHDDSHFHERHK CIN-FFVKVYGYMPLLYTQFRVDSVLFKTRL-PHDKTKCFKFI corresponding to amino acids 820-919 of EXL3_HUMAN (SEQ ID NO:1436), which also corresponds to amino acids 808-907 of M79217_PEA__1_P2 (SEQ ID NO:1337), wherein said first amino acid sequence and second amino acid sequence are contiguous and in a sequential order.

2. An isolated chimeric polypeptide encoding for an edge portion of M79217_PEA__1_P2 (SEQ ID NO:1337), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KA, having a structure as follows: a sequence starting from any of amino acid numbers 807-x to 807; and ending at any of amino acid numbers 808+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein M79217_PEA__1_P2 (SEQ ID NO:1337) also has the following non-silent SNPs (Single Nucleotide Polymorphisms) as listed in Table 583, (given according to their position(s) on the amino acid sequence, with the alternative amino acid(s) listed; the last column indicates whether the SNP is known or not; the presence of known SNPs in variant protein M79217_PEA__1_P2 (SEQ ID NO:1337) sequence provides support for the deduced sequence of this variant protein according to the present invention).

TABLE 583

Amino acid mutations

| SNP position(s) on amino acid sequence | Alternative amino acid(s) | Previously known SNP? |
|---|---|---|
| 104 | N -> D | No |
| 123 | N -> D | No |
| 157 | I -> | No |
| 158 | R -> Q | No |
| 204 | F -> L | No |

TABLE 583-continued

Amino acid mutations

| SNP position(s) on amino acid sequence | Alternative amino acid(s) | Previously known SNP? |
|---|---|---|
| 381 | A -> | No |
| 482 | A -> | No |
| 520 | F -> C | No |
| 706 | L -> P | Yes |
| 760 | V -> A | No |
| 767 | R -> L | No |
| 771 | F -> | No |
| 837 | I -> V | No |
| 875 | Y -> C | No |

The glycosylation sites of variant protein M79217_PEA__1_P2 (SEQ ID NO:1337), as compared to the known protein Exostosin-like 3 (SEQ ID NO:1436), are described in Table 584 (given according to their position(s) on the amino acid sequence in the first column; the second column indicates whether the glycosylation site is present in the variant protein; and the last column indicates whether the position is different on the variant protein).

TABLE 584

Glycosylation site(s)

| Position(s) on known acid sequence | Present in variant protein? | Position in variant protein? |
|---|---|---|
| 290 | yes | 290 |
| 592 | yes | 592 |
| 790 | yes | 790 |
| 277 | yes | 277 |

Variant protein M79217_PEA__1_P2 (SEQ ID NO:1337) is encoded by the following transcript(s): M79217_PEA__1_T8 (SEQ ID NO:61), for which the sequence(s) is/are given at the end of the application. The coding portion of transcript M79217_PEA__1_T8 (SEQ ID NO:61) is shown in bold; this coding portion starts at position 748 and ends at position 3468. The transcript also has the following SNPs as listed in Table 585 (given according to their position on the nucleotide sequence, with the alternative nucleic acid listed; the last column indicates whether the SNP is known or not; the presence of known SNPs in variant protein M79217_PEA__1_P2 (SEQ ID NO:1337) sequence provides support for the deduced sequence of this variant protein according to the present invention).

TABLE 585

Nucleic acid SNPs

| SNP position on nucleotide sequence | Alternative nucleic acid | Previously known SNP? |
|---|---|---|
| 688 | C -> T | No |
| 689 | T -> | No |
| 746 | T -> C | No |
| 906 | T -> A | No |
| 1057 | A -> G | No |
| 1114 | A -> G | No |
| 1218 | C -> | No |
| 1220 | G -> A | No |
| 1359 | T -> G | No |
| 1889 | C -> | No |
| 1974 | A -> G | Yes |
| 2157 | T -> C | No |
| 2192 | C -> | No |

TABLE 585-continued

Nucleic acid SNPs

| SNP position on nucleotide sequence | Alternative nucleic acid | Previously known SNP? |
|---|---|---|
| 2306 | T -> G | No |
| 2864 | T -> C | Yes |
| 3026 | T -> C | No |
| 3047 | G -> T | No |
| 3060 | C -> | No |
| 3123 | C -> T | Yes |
| 3256 | A -> G | No |
| 3371 | A -> G | No |
| 3659 | C -> | No |
| 3659 | C -> T | No |
| 3724 | G -> A | No |
| 3725 | G -> A | No |
| 4054 | T -> A | No |
| 4224 | G -> A | Yes |
| 4410 | C -> T | No |
| 4748 | C -> T | Yes |
| 4857 | C -> T | Yes |
| 5075 | G -> A | No |
| 5283 | G -> A | No |
| 5381 | G -> A | Yes |
| 5525 | G -> T | Yes |
| 5781 | A -> C | No |
| 5915 | G -> | No |
| 5915 | G -> C | No |
| 5933 | C -> G | Yes |
| 5946 | T -> A | No |
| 6041 | G -> A | Yes |
| 6080 | G -> | No |
| 6133 | C -> T | No |

Variant protein M79217_PEA_1_P4 (SEQ ID NO:1338) according to the present invention has an amino acid sequence as given at the end of the application; it is encoded by transcript(s) M79217_PEA_1_T10 (SEQ ID NO:62). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison Report Between M79217_PEA_1_P4 (SEQ ID NO:1338) and EXL3_HUMAN (SEQ ID NO:1436):

1. An isolated chimeric polypeptide encoding for M79217_PEA_1_P4 (SEQ ID NO:1338), comprising a first amino acid sequence being at least 70%, optionally at least 80%, preferably at least 85%, more preferably at least 90% and most preferably at least 95% homologous to a polypeptide having the sequence PELRQPARLGLPECWDYRHEP-RCPAQMGSHFIVQAGLKLLASSKPPKCWDY (SEQ ID NO:1724) corresponding to amino acids 1-51 of M79217_PEA_1_P4 (SEQ ID NO:1338), and a second amino acid sequence being at least 90% homologous to RVWREARDRIVGFPGRYHAWD-IPHQSWLYNSNYSCELSMVLTGAAFFHKYYAYLYSYVMPQAIRDMVDEYINCEDIAMN-FLVSHITRKPPIKVTSRWTFRCPGCPQALSHDDSHFH ERHKCINFFVKVYGYMPLLYTQFRVDSV-LFKTRLPHDKTKCFKFI corresponding to amino acids 759-919 of EXL3_HUMAN (SEQ ID NO:1436), which also corresponds to amino acids 52-212 of M79217_PEA_1_P4 (SEQ ID NO:1338), wherein said first amino acid sequence and second amino acid sequence are contiguous and in a sequential order.

2. An isolated polypeptide encoding for a head of M79217_PEA_1_P4 (SEQ ID NO:1338), comprising a polypeptide being at least 70%, optionally at least about 80%, preferably at least about 85%, more preferably at least about 90% and most preferably at least about 95% homologous to the sequence PELRQPARLGLPECWDYRHEPRC-PAQMGSHFIVQAGLKLLASSKPPKCWDY (Seq id no:1724) of M79217_PEA_1_P4 (SEQ ID NO:1338).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein M79217_PEA_1_P4 (SEQ ID NO:1338) also has the following non-silent SNPs (Single Nucleotide Polymorphisms) as listed in Table 586, (given according to their position(s) on the amino acid sequence, with the alternative amino acid(s) listed; the last column indicates whether the SNP is known or not; the presence of known SNPs in variant protein M79217_PEA_1_P4 (SEQ ID NO:1338) sequence provides support for the deduced sequence of this variant protein according to the present invention).

TABLE 586

Amino acid mutations

| SNP position(s) on amino acid sequence | Alternative amino acid(s) | Previously known SNP? |
|---|---|---|
| 53 | V -> A | No |
| 60 | R -> L | No |
| 64 | F -> | No |
| 142 | I -> V | No |
| 180 | Y -> C | No |

The glycosylation sites of variant protein M79217_PEA_1_P4 (SEQ ID NO:1338), as compared to the known protein Exostosin-like 3 (SEQ ID NO:1436), are described in Table 587 (given according to their position(s) on the amino acid sequence in the first column; the second column indicates whether the glycosylation site is present in the variant protein; and the last column indicates whether the position is different on the variant protein).

TABLE 587

Glycosylation site(s)

| Position(s) on known amino acid sequence | Present in variant protein? | Position in variant protein? |
|---|---|---|
| 290 | no | |
| 592 | no | |
| 790 | yes | 83 |
| 277 | no | |

Variant protein M79217_PEA_1_P4 (SEQ ID NO:1338) is encoded by the following transcript(s): M79217_PEA_1_T10 (SEQ ID NO:62), for which the sequence(s) is/are given at the end of the application. The coding portion of transcript M79217_PEA_1_T10 (SEQ ID NO:62) is shown in bold; this coding portion starts at position 1 and ends at position 637. The transcript also has the following SNPs as listed in Table 588 (given according to their position on the nucleotide sequence, with the alternative nucleic acid listed;

the last column indicates whether the SNP is known or not; the presence of known SNPs in variant protein M79217_PEA_1_P4 (SEQ ID NO:1338) sequence provides support for the deduced sequence of this variant protein according to the present invention).

TABLE 588

Nucleic acid SNPs

| SNP position on nucleotide sequence | Alternative nucleic acid | Previously known SNP? |
|---|---|---|
| 159 | T -> C | No |
| 180 | G -> T | No |
| 193 | C -> | No |
| 256 | C -> T | Yes |
| 425 | A -> G | No |
| 540 | A -> G | No |
| 828 | C -> | No |
| 828 | C -> T | No |
| 893 | G -> A | No |
| 894 | G -> A | No |
| 1223 | T -> A | No |
| 1393 | G -> A | Yes |
| 1579 | C -> T | No |
| 1917 | C -> T | Yes |
| 2026 | C -> T | Yes |
| 2244 | G -> A | No |
| 2452 | G -> A | No |
| 2550 | G -> A | Yes |
| 2694 | G -> T | Yes |
| 2950 | A -> C | No |
| 3084 | G -> | No |
| 3084 | G -> C | No |
| 3102 | C -> G | Yes |
| 3115 | T -> A | No |
| 3210 | G -> A | Yes |
| 3249 | G -> | No |
| 3302 | C -> T | No |

Variant protein M79217_PEA_1_P8 (SEQ ID NO:1339) according to the present invention has an amino acid sequence as given at the end of the application; it is encoded by transcript(s) M79217_PEA_1_T15 (SEQ ID NO:63). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison Report Between M79217_PEA_1_P8 (SEQ ID NO:1339) and EXL3_HUMAN (SEQ ID NO:1436):

1. An isolated chimeric polypeptide encoding for M79217_PEA_1_P8 (SEQ ID NO:1339) comprising a first amino acid sequence being at least 90% homologous to MTGYTMLRNGGAGNGGQTCMLRWSNR-IRLTWLSFTLFVILVFFPLIAHYYLTTLDEAD EAGKRIFGPRVGNELCEVKHVLDLCR-IRESVSEELLQLEAKRQELNSEIAKLNLKIEACK KSIENAKQDLLQLKNVISQTEHSYKEL-MAQNQPKLSLPIRLLPEKDDAGLPPPKATRGC RLHNCFDYSRCPLTSGFPVYVYDS-DQFVFGSYLDPLVKQAFQATARANVYVTENADIA CLYVILVGEMQEPVVLRPAELEKQLYSL-PHWRTDGHNHVIINLSRKSDTQNLLYNVSTG RAM-VAQSTFYTVQYRPGFDLVVSPLVHAM-SEPNFMEIPPQVPVKRKYLFTFQGEKIESL RSSLQEARSFEEEMEGDPPADYDDRII-ATLKAVQDSKLDQVLVEFTCKNQPKPSLPTEW ALCGEREDRLELLKLSTFALIITPGD-PRLVISSGCATRLFEALEVGAVPVVLGEQVQLPY QDMLQWNEAALVVPKPRVTEVHFLL-RSLSDSDLLAMRRQGRFLWETYFSTADSIFNTV LAMIRTRIQIPAAPIREEAAAEIPHRSG-KAAGTDPNMADNGDLDLGPVETEPPYASPRYL RNFTLTVTDFYRSWNCAPGPFHLFPHT-PFDPVLPSEAKFLGSGTGFRPIGGGAGGSGKEF QAALGGNVPREQFTVVMLTYEREEV-LMNSLERLNGLPYLNKVVVVWNSPKLPSEDLL WPDIGVPIMVVRTEKNSLNNRFLPWNEI-ETEAILSIDDDAHLRHDEIMFGFRVWREARD RIVGF-PGRYHAWDIPHQSWLYNSNYSCELSMVLTGAAFFHK corresponding to amino acids 1-807 of EXL3_HUMAN (SEQ ID NO:1436), which also corresponds to amino acids 1-807 of M79217_PEA_1_P8 (SEQ ID NO:1339), and a second amino acid sequence being at least 70%, optionally at least 80%, preferably at least 85%, more preferably at least 90% and most preferably at least 95% homologous to a polypeptide having the sequence VRKSW (SEQ ID NO:1725) corresponding to amino acids 808-812 of M79217_PEA_1_P8 (SEQ ID NO:1339), wherein said first amino acid sequence and second amino acid sequence are contiguous and in a sequential order.

2. An isolated polypeptide encoding for a tail of M79217_PEA_1_P8 (SEQ ID NO:1339), comprising a polypeptide being at least 70%, optionally at least about 80%, preferably at least about 85%, more preferably at least about 90% and most preferably at least about 95% homologous to the sequence VRKSW (SEQ ID NO:1725) in M79217_PEA_1_P8 (SEQ ID NO:1339).

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein M79217_PEA_1_P8 (SEQ ID NO:1339) also has the following non-silent SNPs (Single Nucleotide Polymorphisms) as listed in Table 589, (given according to their position(s) on the amino acid sequence, with the alternative amino acid(s) listed; the last column indicates whether the SNP is known or not; the presence of known SNPs in variant protein M79217_PEA_1_P8 (SEQ ID NO:1339) sequence provides support for the deduced sequence of this variant protein according to the present invention).

TABLE 589

Amino acid mutations

| SNP position(s) on amino acid sequence | Alternative amino acid(s) | Previously known SNP? |
|---|---|---|
| 104 | N -> D | No |
| 123 | N -> D | No |
| 157 | I -> | No |
| 158 | R -> Q | No |
| 204 | F -> L | No |
| 381 | A -> | No |
| 482 | A -> | No |
| 520 | F -> C | No |
| 706 | L -> P | Yes |
| 760 | V -> A | No |
| 767 | R -> L | No |
| 771 | F -> | No |

The glycosylation sites of variant protein M79217_PEA_1_P8 (SEQ ID NO:1339), as compared to the known protein Exostosin-like 3 (SEQ ID NO:1436), are described in Table 590 (given according to their position(s) on the amino acid sequence in the first column; the second column indicates whether the glycosylation site is present in the variant protein; and the last column indicates whether the position is different on the variant protein).

TABLE 590

Glycosylation site(s)

| Position(s) on known amino acid sequence | Present in variant protein? | Position in variant protein? |
|---|---|---|
| 290 | yes | 290 |
| 592 | yes | 592 |
| 790 | yes | 790 |
| 277 | yes | 277 |

Variant protein M79217_PEA_1_P8 (SEQ ID NO:1339) is encoded by the following transcript(s): M79217_PEA_1_T15 (SEQ ID NO:63), for which the sequence(s) is/are given at the end of the application. The coding portion of transcript M79217_PEA_1_T15 (SEQ ID NO:63) is shown in bold; this coding portion starts at position 748 and ends at position 3183. The transcript also has the following SNPs as listed in Table 591 (given according to their position on the nucleotide sequence, with the alternative nucleic acid listed; the last column indicates whether the SNP is known or not; the presence of known SNPs in variant protein M79217_PEA_1_P8 (SEQ ID NO:1339) sequence provides support for the deduced sequence of this variant protein according to the present invention).

TABLE 591

Nucleic acid SNPs

| SNP position on nucleotide sequence | Alternative nucleic acid | Previously known SNP? |
|---|---|---|
| 688 | C -> T | No |
| 689 | T -> | No |
| 746 | T -> C | No |
| 906 | T -> A | No |
| 1057 | A -> G | No |
| 1114 | A -> G | No |
| 1218 | C -> | No |
| 1220 | G -> A | No |
| 1359 | T -> G | No |
| 1889 | C -> | No |
| 1974 | A -> G | Yes |
| 2157 | T -> C | No |
| 2192 | C -> | No |
| 2306 | T -> G | No |
| 2864 | T -> C | Yes |
| 3026 | T -> C | No |
| 3047 | G -> T | No |
| 3060 | C -> | No |
| 3123 | C -> T | Yes |
| 3391 | C -> T | No |
| 3560 | T -> C | No |

Variant protein M79217_PEA_1_P11 (SEQ ID NO:1340) according to the present invention has an amino acid sequence as given at the end of the application; it is encoded by transcript(s) M79217_PEA_1_T18 (SEQ ID NO:64). The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein M79217_PEA_1_P11 (SEQ ID NO:1340) also has the following non-silent SNPs (Single Nucleotide Polymorphisms) as listed in Table 592, (given according to their position(s) on the amino acid sequence, with the alternative amino acid(s) listed; the last column indicates whether the SNP is known or not; the presence of known SNPs in variant protein M79217_PEA_1_P11 (SEQ ID NO:1340) sequence provides support for the deduced sequence of this variant protein according to the present invention).

TABLE 592

Amino acid mutations

| SNP position(s) on amino acid sequence | Alternative amino acid(s) | Previously known SNP? |
|---|---|---|
| 17 | P -> | No |
| 28 | C -> S | No |
| 72 | V -> | No |
| 90 | S -> F | No |

Variant protein M79217_PEA_1_P11 (SEQ ID NO:1340) is encoded by the following transcript(s): M79217_PEA_1_T18 (SEQ ID NO:64), for which the sequence(s) is/are given at the end of the application. The coding portion of transcript M79217_PEA_1_T18 (SEQ ID NO:64) is shown in bold; this coding portion starts at position 1354 and ends at position 1674. The transcript also has the following SNPs as listed in Table 593 (given according to their position on the nucleotide sequence, with the alternative nucleic acid listed; the last column indicates whether the SNP is known or not; the presence of known SNPs in variant protein M79217_PEA_1_P11 (SEQ ID NO:1340) sequence provides support for the deduced sequence of this variant protein according to the present invention).

TABLE 593

Nucleic acid SNPs

| SNP position on nucleotide sequence | Alternative nucleic acid | Previously known SNP? |
|---|---|---|
| 688 | C -> T | No |
| 689 | T -> | No |
| 746 | T -> C | No |
| 772 | G -> A | No |
| 870 | G -> A | Yes |
| 1014 | G -> T | Yes |
| 1270 | A -> C | No |
| 1404 | G -> | No |
| 1404 | G -> C | No |
| 1422 | C -> G | Yes |
| 1435 | T -> A | No |
| 1530 | G -> A | Yes |
| 1569 | G -> | No |
| 1622 | C -> T | No |

As noted above, cluster M79217 features 32 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster M79217_PEA_1_node_2 (SEQ ID NO:584) according to the present invention is supported by 2 libraries. The number of libraries was determined as previously described. This segment can be found in the following transcript(s): M79217_PEA_1_T3 (SEQ ID NO:60). Table 594 below describes the starting and ending position of this segment on each transcript.

TABLE 594

Segment location on transcripts

| Transcript name | Segment starting position | Segment ending position |
|---|---|---|
| M79217_PEA_1_T3 (SEQ ID NO: 60) | 50 | 177 |

Segment cluster M79217_PEA_1_node_4 (SEQ ID NO:585) according to the present invention is supported by 8 libraries. The number of libraries was determined as previously described. This segment can be found in the following transcript(s): M79217_PEA_1_T8 (SEQ ID NO:61), M79217_PEA_1_T15 (SEQ ID NO:63) and M79217_PEA_1_T18 (SEQ ID NO:64). Table 595 below describes the starting and ending position of this segment on each transcript.

TABLE 595

Segment location on transcripts

| Transcript name | Segment starting position | Segment ending position |
|---|---|---|
| M79217_PEA_1_T8 (SEQ ID NO: 61) | 1 | 177 |
| M79217_PEA_1_T15 (SEQ ID NO: 63) | 1 | 177 |
| M79217_PEA_1_T18 (SEQ ID NO: 64) | 1 | 177 |

Segment cluster M79217_PEA_1_node_9 (SEQ ID NO:586) according to the present invention is supported by 2 libraries. The number of libraries was determined as previously described. This segment can be found in the following transcript(s): M79217_PEA_1_T1 (SEQ ID NO:59). Table 596 below describes the starting and ending position of this segment on each transcript.

TABLE 596

Segment location on transcripts

| Transcript name | Segment starting position | Segment ending position |
|---|---|---|
| M79217_PEA_1_T1 (SEQ ID NO: 59) | 1 | 597 |

Segment cluster M79217_PEA_1_node_10 (SEQ ID NO:587) according to the present invention is supported by 33 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T15 (SEQ ID NO:63) and M79217_PEA_1_T18 (SEQ ID NO:64). Table 597 below describes the starting and ending position of this segment on each transcript.

TABLE 597

Segment location on transcripts

| Transcript name | Segment starting position | Segment ending position |
|---|---|---|
| M79217_PEA_1_T1 (SEQ ID NO: 59) | 598 | 1080 |
| M79217_PEA_1_T3 (SEQ ID NO: 60) | 272 | 754 |
| M79217_PEA_1_T8 (SEQ ID NO: 61) | 272 | 754 |
| M79217_PEA_1_T15 (SEQ ID NO: 63) | 272 | 754 |
| M79217_PEA_1_T18 (SEQ ID NO: 64) | 272 | 754 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 598.

TABLE 598

Oligonucleotides related to this segment

| Oligonucleotide name | Overexpressed in cancers | Chip reference |
|---|---|---|
| M79217_0_9_0 | lung malignant tumors | LUN |

Segment cluster M79217_PEA_1_node_11 (SEQ ID NO:588) according to the present invention is supported by 42 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 599 below describes the starting and ending position of this segment on each transcript.

TABLE 599

Segment location on transcripts

| Transcript name | Segment starting position | Segment ending position |
|---|---|---|
| M79217_PEA_1_T1 (SEQ ID NO: 59) | 1081 | 1523 |
| M79217_PEA_1_T3 (SEQ ID NO: 60) | 755 | 1197 |
| M79217_PEA_1_T8 (SEQ ID NO: 61) | 755 | 1197 |
| M79217_PEA_1_T15 (SEQ ID NO: 63) | 755 | 1197 |

Segment cluster M79217_PEA_1_node_13 (SEQ ID NO:589) according to the present invention is supported by 35 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 600 below describes the starting and ending position of this segment on each transcript.

TABLE 600

Segment location on transcripts

| Transcript name | Segment starting position | Segment ending position |
|---|---|---|
| M79217_PEA_1_T1 (SEQ ID NO: 59) | 1548 | 2075 |
| M79217_PEA_1_T3 (SEQ ID NO: 60) | 1222 | 1749 |
| M79217_PEA_1_T8 (SEQ ID NO: 61) | 1222 | 1749 |
| M79217_PEA_1_T15 (SEQ ID NO: 63) | 1222 | 1749 |

Segment cluster M79217_PEA_1_node_14 (SEQ ID NO:590) according to the present invention is supported by 65 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 601 below describes the starting and ending position of this segment on each transcript.

TABLE 601

Segment location on transcripts

| Transcript name | Segment starting position | Segment ending position |
|---|---|---|
| M79217_PEA_1_T1 (SEQ ID NO: 59) | 2076 | 3221 |
| M79217_PEA_1_T3 (SEQ ID NO: 60) | 1750 | 2895 |
| M79217_PEA_1_T8 (SEQ ID NO: 61) | 1750 | 2895 |
| M79217_PEA_1_T15 (SEQ ID NO: 63) | 1750 | 2895 |

Segment cluster M79217_PEA_1_node_16 (SEQ ID NO:591) according to the present invention is supported by 51 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 602 below describes the starting and ending position of this segment on each transcript.

TABLE 602

Segment location on transcripts

| Transcript name | Segment starting position | Segment ending position |
|---|---|---|
| M79217_PEA_1_T1 (SEQ ID NO: 59) | 3222 | 3349 |
| M79217_PEA_1_T3 (SEQ ID NO: 60) | 2896 | 3023 |
| M79217_PEA_1_T8 (SEQ ID NO: 61) | 2896 | 3023 |
| M79217_PEA_1_T15 (SEQ ID NO: 63) | 2896 | 3023 |

Segment cluster M79217_PEA_1_node_23 (SEQ ID NO:592) according to the present invention is supported by 50 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T15 (SEQ ID NO:63). Table 603 below describes the starting and ending position of this segment on each transcript.

TABLE 603

Segment location on transcripts

| Transcript name | Segment starting position | Segment ending position |
|---|---|---|
| M79217_PEA_1_T1 (SEQ ID NO: 59) | 3350 | 3494 |
| M79217_PEA_1_T3 (SEQ ID NO: 60) | 3024 | 3168 |
| M79217_PEA_1_T8 (SEQ ID NO: 61) | 3024 | 3168 |
| M79217_PEA_1_T10 (SEQ ID NO: 62) | 157 | 301 |
| M79217_PEA_1_T15 (SEQ ID NO: 63) | 3024 | 3168 |

Segment cluster M79217_PEA_1_node_24 (SEQ ID NO:593) according to the present invention is supported by 2 libraries. The number of libraries was determined as previously described. This segment can be found in the following transcript(s): M79217_PEA_1_T15 (SEQ ID NO:63). Table 604 below describes the starting and ending position of this segment on each transcript.

TABLE 604

Segment location on transcripts

| Transcript name | Segment starting position | Segment ending position |
|---|---|---|
| M79217_PEA_1_T15 (SEQ ID NO: 63) | 3169 | 3580 |

Segment cluster M79217_PEA_1_node_31 (SEQ ID NO:594) according to the present invention is supported by 50 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 605 below describes the starting and ending position of this segment on each transcript.

TABLE 605

Segment location on transcripts

| Transcript name | Segment starting position | Segment ending position |
|---|---|---|
| M79217_PEA_1_T1 (SEQ ID NO: 59) | 3716 | 3960 |
| M79217_PEA_1_T3 (SEQ ID NO: 60) | 3390 | 3634 |
| M79217_PEA_1_T8 (SEQ ID NO: 61) | 3354 | 3598 |
| M79217_PEA_1_T10 (SEQ ID NO: 62) | 523 | 767 |

Segment cluster M79217_PEA_1_node_33 (SEQ ID NO:595) according to the present invention is supported by 71 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 606 below describes the starting and ending position of this segment on each transcript.

TABLE 606

Segment location on transcripts

| Transcript name | Segment starting position | Segment ending position |
|---|---|---|
| M79217_PEA_1_T1 (SEQ ID NO: 59) | 4015 | 4631 |
| M79217_PEA_1_T3 (SEQ ID NO: 60) | 3689 | 4305 |
| M79217_PEA_1_T8 (SEQ ID NO: 61) | 3653 | 4269 |
| M79217_PEA_1_T10 (SEQ ID NO: 62) | 822 | 1438 |

Segment cluster M79217_PEA_1_node_34 (SEQ ID NO:596) according to the present invention is supported by 51 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 607 below describes the starting and ending position of this segment on each transcript.

TABLE 607

Segment location on transcripts

| Transcript name | Segment starting position | Segment ending position |
|---|---|---|
| M79217_PEA_1_T1 (SEQ ID NO: 59) | 4632 | 4869 |
| M79217_PEA_1_T3 (SEQ ID NO: 60) | 4306 | 4543 |
| M79217_PEA_1_T8 (SEQ ID NO: 61) | 4270 | 4507 |
| M79217_PEA_1_T10 (SEQ ID NO: 62) | 1439 | 1676 |

Segment cluster M79217_PEA_1_node_35 (SEQ ID NO:597) according to the present invention is supported by 53 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 608 below describes the starting and ending position of this segment on each transcript.

TABLE 608

Segment location on transcripts

| Transcript name | Segment starting position | Segment ending position |
|---|---|---|
| M79217_PEA_1_T1 (SEQ ID NO: 59) | 4870 | 4997 |
| M79217_PEA_1_T3 (SEQ ID NO: 60) | 4544 | 4671 |
| M79217_PEA_1_T8 (SEQ ID NO: 61) | 4508 | 4635 |
| M79217_PEA_1_T10 (SEQ ID NO: 62) | 1677 | 1804 |

Segment cluster M79217_PEA_1_node_37 (SEQ ID NO:598) according to the present invention is supported by 58 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 609 below describes the starting and ending position of this segment on each transcript.

TABLE 609

Segment location on transcripts

| Transcript name | Segment starting position | Segment ending position |
|---|---|---|
| M79217_PEA_1_T1 (SEQ ID NO: 59) | 5039 | 5280 |
| M79217_PEA_1_T3 (SEQ ID NO: 60) | 4713 | 4954 |
| M79217_PEA_1_T8 (SEQ ID NO: 61) | 4677 | 4918 |
| M79217_PEA_1_T10 (SEQ ID NO: 62) | 1846 | 2087 |

Segment cluster M79217_PEA_1_node_38 (SEQ ID NO:599) according to the present invention is supported by 62 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 610 below describes the starting and ending position of this segment on each transcript.

TABLE 610

Segment location on transcripts

| Transcript name | Segment starting position | Segment ending position |
|---|---|---|
| M79217_PEA_1_T1 (SEQ ID NO: 59) | 5281 | 5436 |
| M79217_PEA_1_T3 (SEQ ID NO: 60) | 4955 | 5110 |
| M79217_PEA_1_T8 (SEQ ID NO: 61) | 4919 | 5074 |
| M79217_PEA_1_T10 (SEQ ID NO: 62) | 2088 | 2243 |

Segment cluster M79217_PEA_1_node_41 (SEQ ID NO:600) according to the present invention is supported by 171 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T18 (SEQ ID NO:64). Table 611 below describes the starting and ending position of this segment on each transcript.

TABLE 611

Segment location on transcripts

| Transcript name | Segment starting position | Segment ending position |
|---|---|---|
| M79217_PEA_1_T1 (SEQ ID NO: 59) | 5628 | 6357 |
| M79217_PEA_1_T3 (SEQ ID NO: 60) | 5302 | 6031 |
| M79217_PEA_1_T8 (SEQ ID NO: 61) | 5266 | 5995 |
| M79217_PEA_1_T10 (SEQ ID NO: 62) | 2435 | 3164 |
| M79217_PEA_1_T18 (SEQ ID NO: 64) | 755 | 1484 |

Segment cluster M79217_PEA_1_node_44 (SEQ ID NO:601) according to the present invention is supported by 89 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T18 (SEQ ID NO:64). Table 612 below describes the starting and ending position of this segment on each transcript.

TABLE 612

Segment location on transcripts

| Transcript name | Segment starting position | Segment ending position |
|---|---|---|
| M79217_PEA_1_T1 (SEQ ID NO: 59) | 6472 | 6659 |
| M79217_PEA_1_T3 (SEQ ID NO: 60) | 6146 | 6333 |
| M79217_PEA_1_T8 (SEQ ID NO: 61) | 6110 | 6297 |
| M79217_PEA_1_T10 (SEQ ID NO: 62) | 3279 | 3466 |
| M79217_PEA_1_T18 (SEQ ID NO: 64) | 1599 | 1786 |

According to an optional embodiment of the present invention, short segments related to the above cluster are also provided. These segments are up to about 120 bp in length, and so are included in a separate description.

Segment cluster M79217_PEA_1_node_0 (SEQ ID NO:602) according to the present invention is supported by 4 libraries. The number of libraries was determined as previously described. This segment can be found in the following transcript(s): M79217_PEA_1_T3 (SEQ ID NO:60). Table 613 below describes the starting and ending position of this segment on each transcript.

TABLE 613

Segment location on transcripts

| Transcript name | Segment starting position | Segment ending position |
|---|---|---|
| M79217_PEA_1_T3 (SEQ ID NO:60) | 1 | 49 |

Segment cluster M79217_PEA_1_node_7 (SEQ ID NO:603) according to the present invention is supported by 11 libraries. The number of libraries was determined as previously described. This segment can be found in the following transcript(s): M79217_PEA_1_T3 (SEQ ID NO:60), M79217_PEA_1_T8 (SEQ ID NO:61), M79217_PEA_1_T15 (SEQ ID NO:63) and M79217_PEA_1_T18 (SEQ ID NO:64). Table 614 below describes the starting and ending position of this segment on each transcript.

TABLE 614

Segment location on transcripts

| Transcript name | Segment starting position | Segment ending position |
|---|---|---|
| M79217_PEA_1_T3 (SEQ ID NO: 60) | 178 | 271 |
| M79217_PEA_1_T8 (SEQ ID NO: 61) | 178 | 271 |
| M79217_PEA_1_T15 (SEQ ID NO: 63) | 178 | 271 |
| M79217_PEA_1_T18 (SEQ ID NO: 64) | 178 | 271 |

Segment cluster M79217_PEA_1_node_12 (SEQ ID NO:604) according to the present invention can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 615 below describes the starting and ending position of this segment on each transcript.

TABLE 615

Segment location on transcripts

| Transcript name | Segment starting position | Segment ending position |
|---|---|---|
| M79217_PEA_1_T1 (SEQ ID NO: 59) | 1524 | 1547 |
| M79217_PEA_1_T3 (SEQ ID NO: 60) | 1198 | 1221 |
| M79217_PEA_1_T8 (SEQ ID NO: 61) | 1198 | 1221 |
| M79217_PEA_1_T15 (SEQ ID NO: 63) | 1198 | 1221 |

Segment cluster M79217_PEA_1_node_19 (SEQ ID NO:605) according to the present invention is supported by 1 libraries. The number of libraries was determined as previously described. This segment can be found in the following transcript(s): M79217_PEA_1_T10 (SEQ ID NO:62). Table 616 below describes the starting and ending position of this segment on each transcript.

TABLE 616

Segment location on transcripts

| Transcript name | Segment starting position | Segment ending position |
|---|---|---|
| M79217_PEA_1_T10 (SEQ ID NO: 62) | 1 | 79 |

Segment cluster M79217_PEA_1_node_21 (SEQ ID NO:606) according to the present invention is supported by 1 libraries. The number of libraries was determined as previously described. This segment can be found in the following transcript(s): M79217_PEA_1_T10 (SEQ ID NO:62). Table 617 below describes the starting and ending position of this segment on each transcript.

TABLE 617

Segment location on transcripts

| Transcript name | Segment starting position | Segment ending position |
|---|---|---|
| M79217_PEA_1_T10 (SEQ ID NO: 62) | 80 | 156 |

Segment cluster M79217_PEA_1_node_26 (SEQ ID NO:607) according to the present invention is supported by 40 libraries. The number of libraries was determined as previously described. This segment can be found in the following transcript(s): M79217_PEA_1_T1 (SEQ ID NO:59), M79217_PEA_1_T3 (SEQ ID NO:60) and M79217_PEA_1_T10 (SEQ ID NO:62). Table 618 below describes the starting and ending position of this segment on each transcript.

TABLE 618

Segment location on transcripts

| Transcript name | Segment starting position | Segment ending position |
|---|---|---|
| M79217_PEA_1_T1 (SEQ ID NO: 59) | 3495 | 3530 |
| M79217_PEA_1_T3 (SEQ ID NO: 60) | 3169 | 3204 |

TABLE 618-continued

Segment location on transcripts

| Transcript name | Segment starting position | Segment ending position |
|---|---|---|
| M79217_PEA_1_T10 (SEQ ID NO: 62) | 302 | 337 |

Segment cluster M79217_PEA_1_node_27 (SEQ ID NO:608) according to the present invention is supported by 46 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 619 below describes the starting and ending position of this segment on each transcript.

TABLE 619

Segment location on transcripts

| Transcript name | Segment starting position | Segment ending position |
|---|---|---|
| M79217_PEA_1_T1 (SEQ ID NO: 59) | 3531 | 3623 |
| M79217_PEA_1_T3 (SEQ ID NO: 60) | 3205 | 3297 |
| M79217_PEA_1_T8 (SEQ ID NO: 61) | 3169 | 3261 |
| M79217_PEA_1_T10 (SEQ ID NO: 62) | 338 | 430 |

Segment cluster M79217_PEA_1_node_30 (SEQ ID NO:609) according to the present invention is supported by 47 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 620 below describes the starting and ending position of this segment on each transcript.

TABLE 620

Segment location on transcripts

| Transcript name | Segment starting position | Segment ending position |
|---|---|---|
| M79217_PEA_1_T1 (SEQ ID NO: 59) | 3624 | 3715 |
| M79217_PEA_1_T3 (SEQ ID NO: 60) | 3298 | 3389 |
| M79217_PEA_1_T8 (SEQ ID NO: 61) | 3262 | 3353 |
| M79217_PEA_1_T10 (SEQ ID NO: 62) | 431 | 522 |

Segment cluster M79217_PEA_1_node_32 (SEQ ID NO:610) according to the present invention is supported by 40 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 621 below describes the starting and ending position of this segment on each transcript.

TABLE 621

Segment location on transcripts

| Transcript name | Segment starting position | Segment ending position |
|---|---|---|
| M79217_PEA_1_T1 (SEQ ID NO: 59) | 3961 | 4014 |
| M79217_PEA_1_T3 (SEQ ID NO: 60) | 3635 | 3688 |
| M79217_PEA_1_T8 (SEQ ID NO: 61) | 3599 | 3652 |
| M79217_PEA_1_T10 (SEQ ID NO: 62) | 768 | 821 |

Segment cluster M79217_PEA_1_node_36 (SEQ ID NO:611) according to the present invention is supported by 42 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 622 below describes the starting and ending position of this segment on each transcript.

TABLE 622

Segment location on transcripts

| Transcript name | Segment starting position | Segment ending position |
|---|---|---|
| M79217_PEA_1_T1 (SEQ ID NO: 59) | 4998 | 5038 |
| M79217_PEA_1_T3 (SEQ ID NO: 60) | 4672 | 4712 |
| M79217_PEA_1_T8 (SEQ ID NO: 61) | 4636 | 4676 |
| M79217_PEA_1_T10 (SEQ ID NO: 62) | 1805 | 1845 |

Segment cluster M79217_PEA_1_node_39 (SEQ ID NO:612) according to the present invention is supported by 57 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 623 below describes the starting and ending position of this segment on each transcript.

TABLE 623

Segment location on transcripts

| Transcript name | Segment starting position | Segment ending position |
|---|---|---|
| M79217_PEA_1_T1 (SEQ ID NO: 59) | 5437 | 5520 |
| M79217_PEA_1_T3 (SEQ ID NO: 60) | 5111 | 5194 |
| M79217_PEA_1_T8 (SEQ ID NO: 61) | 5075 | 5158 |
| M79217_PEA_1_T10 (SEQ ID NO: 62) | 2244 | 2327 |

Segment cluster M79217_PEA_1_node_40 (SEQ ID NO:613) according to the present invention is supported by 59 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 624 below describes the starting and ending position of this segment on each transcript.

TABLE 624

Segment location on transcripts

| Transcript name | Segment starting position | Segment ending position |
|---|---|---|
| M79217_PEA_1_T1 (SEQ ID NO: 59) | 5521 | 5627 |
| M79217_PEA_1_T3 (SEQ ID NO: 60) | 5195 | 5301 |
| M79217_PEA_1_T8 (SEQ ID NO: 61) | 5159 | 5265 |
| M79217_PEA_1_T10 (SEQ ID NO: 62) | 2328 | 2434 |

Segment cluster M79217_PEA_1_node_42 (SEQ ID NO:614) according to the present invention is supported by 99 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T18 (SEQ ID NO:64). Table 625 below describes the starting and ending position of this segment on each transcript.

TABLE 625

Segment location on transcripts

| Transcript name | Segment starting position | Segment ending position |
|---|---|---|
| M79217_PEA_1_T1 (SEQ ID NO: 59) | 6358 | 6443 |
| M79217_PEA_1_T3 (SEQ ID NO: 60) | 6032 | 6117 |
| M79217_PEA_1_T8 (SEQ ID NO: 61) | 5996 | 6081 |
| M79217_PEA_1_T10 (SEQ ID NO: 62) | 3165 | 3250 |
| M79217_PEA_1_T18 (SEQ ID NO: 64) | 1485 | 1570 |

Segment cluster M79217_PEA_1_node_43 (SEQ ID NO:615) according to the present invention is supported by 90 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T18 (SEQ ID NO:64). Table 626 below describes the starting and ending position of this segment on each transcript.

TABLE 626

Segment location on transcripts

| Transcript name | Segment starting position | Segment ending position |
|---|---|---|
| M79217_PEA_1_T1 (SEQ ID NO: 59) | 6444 | 6471 |
| M79217_PEA_1_T3 (SEQ ID NO: 60) | 6118 | 6145 |
| M79217_PEA_1_T8 (SEQ ID NO: 61) | 6082 | 6109 |
| M79217_PEA_1_T10 (SEQ ID NO: 62) | 3251 | 3278 |
| M79217_PEA_1_T18 (SEQ ID NO: 64) | 1571 | 1598 |

Variant Protein Alignment to the Previously Known Protein:

Sequence name: BAA25445 (SEQ ID NO:1437)

Sequence documentation:

Alignment of: M79217_PEA_1_P1 (SEQ ID NO:1336) x BAA25445 (SEQ ID NO:1437) ..

Alignment segment 1/1:

| | | | |
|---|---|---|---|
| Quality: | 9101.00 | | |
| Escore: | 0 | | |
| Matching length: | 919 | Total length: | 919 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MTGYTMLRNGGAGNGGQTCMLRWSNRIRLTWLSFTLFVILVFFPLIAHYY   50
    |||||||||||||||||||||||||||||||||||||||||||||||||||
 13 MTGYTMLRNGGAGNGGQTCMLRWSNRIRLTWLSFTLFVILVFFPLIAHYY   62

51 LTTLDEADEAGKRIFGPRVGNELCEVKHVLDLCRIRESVSEELLQLEAKR  100
    |||||||||||||||||||||||||||||||||||||||||||||||||||
 63 LTTLDEADEAGKRIFGPRVGNELCEVKHVLDLCRIRESVSEELLQLEAKR  112

101 QELNSEIAKLNLKIEACKKSIENAKQDLLQLKNVISQTEHSYKELMAQNQ  150
    |||||||||||||||||||||||||||||||||||||||||||||||||||
113 QELNSEIAKLNLKIEACKKSIENAKQDLLQLKNVISQTEHSYKELMAQNQ  162

151 PKLSLPIRLLPEKDDAGLPPPKATRGCRLHNCFDYSRCPLTSGFPVYVYD  200
    |||||||||||||||||||||||||||||||||||||||||||||||||||
163 PKLSLPIRLLPEKDDAGLPPPKATRGCRLHNCFDYSRCPLTSGFPVYVYD  212

201 SDQFVFGSYLDPLVKQAFQATARANVYVTENADIACLYVILVGEMQEPVV  250
    |||||||||||||||||||||||||||||||||||||||||||||||||||
213 SDQFVFGSYLDPLVKQAFQATARANVYVTENADIACLYVILVGEMQEPVV  262

251 LRPAELEKQLYSLPHWRTDGHNHVIINLSRKSDTQNLLYNVSTGRAMVAQ  300
    |||||||||||||||||||||||||||||||||||||||||||||||||||
263 LRPAELEKQLYSLPHWRTDGHNHVIINLSRKSDTQNLLYNVSTGRAMVAQ  312

301 STFYTVQYRPGFDLVVSPLVHAMSEPNFMEIPPQVPVKRKYLFTFQGEKI  350
    |||||||||||||||||||||||||||||||||||||||||||||||||||
313 STFYTVQYRPGFDLVVSPLVHAMSEPNFMEIPPQVPVKRKYLFTFQGEKI  362
```

```
351  ESLRSSLQEARSFEEEMEGDPPADYDDRIIATLKAVQDSKLDQVLVEFTC   400
     |||||||||||||||||||||||||||||||||||||||||||||||||
363  ESLRSSLQEARSFEEEMEGDPPADYDDRIIATLKAVQDSKLDQVLVEFTC   412

401  KNQPKPSLPTEWALCGEREDRLELLKLSTFALIITPGDPRLVISSGCATR   450
     |||||||||||||||||||||||||||||||||||||||||||||||||
413  KNQPKPSLPTEWALCGEREDRLELLKLSTFALIITPGDPRLVISSGCATR   462

451  LFEALEVGAVPVVLGEQVQLPYQDMLQWNEAALVVPKPRVTEVHFLLRSL   500
     |||||||||||||||||||||||||||||||||||||||||||||||||
463  LFEALEVGAVPVVLGEQVQLPYQDMLQWNEAALVVPKPRVTEVHFLLRSL   512

501  SDSDLLAMRRQGRFLWETYFSTADSIFNTVLAMIRTRIQIPAAPIREEAA   550
     |||||||||||||||||||||||||||||||||||||||||||||||||
513  SDSDLLAMRRQGRFLWETYFSTADSIFNTVLAMIRTRIQIPAAPIREEAA   562

551  AEIPHRSGKAAGTDPNMADNGDLDLGPVETEPPYASPRYLRNFTLTVTDF   600
     |||||||||||||||||||||||||||||||||||||||||||||||||
563  AEIPHRSGKAAGTDPNMADNGDLDLGPVETEPPYASPRYLRNFTLTVTDF   612

601  YRSWNCAPGPFHLFPHTPFDPVLPSEAKFLGSGTGFRPIGGGAGGSGKEF   650
     |||||||||||||||||||||||||||||||||||||||||||||||||
613  YRSWNCAPGPFHLFPHTPFDPVLPSEAKFLGSGTGFRPIGGGAGGSGKEF   662

651  QAALGGNVPREQFTVVMLTYEREEVLMNSLERLNGLPYLNKVVVVWNSPK   700
     |||||||||||||||||||||||||||||||||||||||||||||||||
663  QAALGGNVPREQFTVVMLTYEREEVLMNSLERLNGLPYLNKVVVVWNSPK   712

701  LPSEDLLWPDIGVPIMVVRTEKNSLNNRFLPWNEIETEAILSIDDDAHLR   750
     |||||||||||||||||||||||||||||||||||||||||||||||||
713  LPSEDLLWPDIGVPIMVVRTEKNSLNNRFLPWNEIETEAILSIDDDAHLR   762

751  HDEIMFGPRVWREARDRIVGFPGRYHAWDIPHQSWLYNSNYSCELSMVLT   800
     |||||||||||||||||||||||||||||||||||||||||||||||||
763  HDEIMFGPRVWREARDRIVGFPGRYHAWDIPHQSWLYNSNYSCELSMVLT   812

801  GAAFFHKYYAYLYSYVMPQAIRDMVDEYINCEDIAMNFLVSHITRKPPIK   850
     |||||||||||||||||||||||||||||||||||||||||||||||||
813  GAAFFHKYYAYLYSYVMPQAIRDMVDEYINCEDIAMNFLVSHITRKPPIK   862

851  VTSRWTFRCPGCPQALSHDDSHFHERHKCINFFVKVYGYMPLLYTQFRVD   900
     |||||||||||||||||||||||||||||||||||||||||||||||||
863  VTSRWTFRCPGCPQALSHDDSHFHERHKCINFFVKVYGYMPLLYTQFRVD   912

901  SVLFKTRLPHDKTKCFKFI                                 919
     |||||||||||||||||||
913  SVLFKTRLPHDKTKCFKFI                                 931
```

Sequence name: EXL3_HUMAN (SEQ ID NO:1436)
Sequence documentation:
Alignment of: M79217_PEA_1_P2 (SEQ ID NO:1337) x EXL3_HUMAN (SEQ ID NO:1436) ..
Alignment segment 1/1:

Quality:            8873.00
Escore:             0

| | | | |
|---|---|---|---|
| Matching length: | 907 | Total length: | 919 |
| Matching Percent Similarity: | 100.00 | Matching Percent Identity: | 100.00 |
| Total Percent Similarity: | 98.69 | Total Percent Identity: | 98.69 |
| Gaps: | 1 | | |

Alignment:

```
  1  MTGYTMLRNGGAGNGGQTCMLRWSNRIRLTWLSFTLFVILVFFPLIAHYY   50
     |||||||||||||||||||||||||||||||||||||||||||||||||
  1  MTGYTMLRNGGAGNGGQTCMLRWSNRIRLTWLSFTLFVILVFFPLIAHYY   50

51  LTTLDEADEAGKRIFGPRVGNELCEVKHVLDLCRIRESVSEELLQLEAKR  100
     |||||||||||||||||||||||||||||||||||||||||||||||||
 51  LTTLDEADEAGKRIFGPRVGNELCEVKHVLDLCRIRESVSEELLQLEAKR  100

101  QELNSEIAKLNLKIEACKKSIENAKQDLLQLKNVISQTEHSYKELMAQNQ  150
     |||||||||||||||||||||||||||||||||||||||||||||||||
101  QELNSEIAKLNLKIEACKKSIENAKQDLLQLKNVISQTEHSYKELMAQNQ  150
```

-continued

```
151  PKLSLPIRLLPEKDDAGLPPPKATRGCRLHNCFDYSRCPLTSGFPVYVYD  200
     ||||||||||||||||||||||||||||||||||||||||||||||||||
151  PKLSLPIRLLPEKDDAGLPPPKATRGCRLHNCFDYSRCPLTSGFPVYVYD  200

201  SDQFVFGSYLDPLVKQAFQATARANVYVTENADIACLYVILVGEMQEPVV  250
     ||||||||||||||||||||||||||||||||||||||||||||||||||
201  SDQFVFGSYLDPLVKQAFQATARANVYVTENADIACLYVILVGEMQEPVV  250

251  LRPAELEKQLYSLPHWRTDGHNHVIINLSRKSDTQNLLYNVSTGRAMVAQ  300
     ||||||||||||||||||||||||||||||||||||||||||||||||||
251  LRPAELEKQLYSLPHWRTDGHNHVIINLSRKSDTQNLLYNVSTGRAMVAQ  300

301  STFYTVQYRPGFDLVVSPLVHAMSEPNFMEIPPQVPVKRKYLFTFQGEKI  350
     ||||||||||||||||||||||||||||||||||||||||||||||||||
301  STFYTVQYRPGFDLVVSPLVHAMSEPNFMEIPPQVPVKRKYLFTFQGEKI  350

351  ESLRSSLQEARSFEEEMEGDPPADYDDRIIATLKAVQDSKLDQVLVEFTC  400
     ||||||||||||||||||||||||||||||||||||||||||||||||||
351  ESLRSSLQEARSFEEEMEGDPPADYDDRIIATLKAVQDSKLDQVLVEFTC  400

401  KNQPKPSLPTEWALCGEREDRLELLKLSTFALIITPGDPRLVISSGCATR  450
     ||||||||||||||||||||||||||||||||||||||||||||||||||
401  KNQPKPSLPTEWALCGEREDRLELLKLSTFALIITPGDPRLVISSGCATR  450

451  LFEALEVGAVPVVLGEQVQLPYQDMLQWNEAALVVPKPRVTEVHFLLRSL  500
     ||||||||||||||||||||||||||||||||||||||||||||||||||
451  LFEALEVGAVPVVLGEQVQLPYQDMLQWNEAALVVPKPRVTEVHFLLRSL  500

501  SDSDLLAMRRQGRFLWETYFSTADSIFNTVLAMIRTRIQIPAAPIREEAA  550
     ||||||||||||||||||||||||||||||||||||||||||||||||||
501  SDSDLLAMRRQGRFLWETYFSTADSIFNTVLAMIRTRIQIPAAPIREEAA  550

551  AEIPHRSGKAAGTDPNMADNGDLDLGPVETEPPYASPRYLRNFTLTVTDF  600
     ||||||||||||||||||||||||||||||||||||||||||||||||||
551  AEIPHRSGKAAGTDPNMADNGDLDLGPVETEPPYASPRYLRNFTLTVTDF  600

601  YRSWNCAPGPFHLFPHTPFDPVLPSEAKFLGSGTGFRPIGGGAGGSGKEF  650
     ||||||||||||||||||||||||||||||||||||||||||||||||||
601  YRSWNCAPGPFHLFPHTPFDPVLPSEAKFLGSGTGFRPIGGGAGGSGKEF  650

651  QAALGGNVPREQFTVVMLTYEREEVLMNSLERLNGLPYLNKVVVVWNSPK  700
     ||||||||||||||||||||||||||||||||||||||||||||||||||
651  QAALGGNVPREQFTVVMLTYEREEVLMNSLERLNGLPYLNKVVVVWNSPK  700

701  LPSEDLLWPDIGVPIMVVRTEKNSLNNRFLPWNEIETEAILSIDDDAHLR  750
     ||||||||||||||||||||||||||||||||||||||||||||||||||
701  LPSEDLLWPDIGVPIMVVRTEKNSLNNRFLPWNEIETEAILSIDDDAHLR  750

751  HDEIMFGFRVWREARDRIVGFPGRYHAWDIPHQSWLYNSNYSCELSMVLT  800
     ||||||||||||||||||||||||||||||||||||||||||||||||||
751  HDEIMFGFRVWREARDRIVGFPGRYHAWDIPHQSWLYNSNYSCELSMVLT  800

801  GAAFFHK...........AIRDMVDEYINCEDIAMNFLVSHITRKPPIK   838
     |||||||            |||||||||||||||||||||||||||||
801  GAAFFHKYYAYLYSYVMPQAIRDMVDEYINCEDIAMNFLVSHITRKPPIK  850

839  VTSRWTFRCPGCPQALSHDDSHFHERHKCINFFVKVYGYMPLLYTQFRVD  888
     ||||||||||||||||||||||||||||||||||||||||||||||||||
851  VTSRWTFRCPGCPQALSHDDSHFHERHKCINFFVKVYGYMPLLYTQFRVD  900

889  SVLFKTRLPHDKTKCFKFI                                907
     |||||||||||||||||||
901  SVLFKTRLPHDKTKCFKFI                                919
```

Sequence name: EXL3_HUMAN (SEQ ID NO:1436)
Sequence documentation:
Alignment of: M79217_PEA_1_P4 (SEQ ID NO:1338) x EXL3_HUMAN (SEQ ID NO:1436) ..
Alignment segment 1/1:

| Quality: | 1668.00 |
| --- | --- |
| Escore: | 0 |
| Matching length: | 162 | Total length: | 162 |
| Matching Percent: | 100.00 | Matching Percent Identity: | 99.38 |
| Similarity: | | | |
| Total Percent Similarity: | 100.00 | Total Percent Identity: | 99.38 |
| Gaps: | 0 | | |

Alignment:

```
 51  YRVWREARDRIVGFPGRYHAWDIPHQSWLYNSNYSCELSMVLTGAAFFHK   100
     :|||||||||||||||||||||||||||||||||||||||||||||||||
758  FRVWREARDRIVGFPGRYHAWDIPHQSWLYNSNYSCELSMVLTGAAFFHK   807

101  YYAYLYSYVMPQAIRDMVDEYINCEDIAMNFLVSHITRKPPIKVTSRWTF   150
     |||||||||||||||||||||||||||||||||||||||||||||||||
808  YYAYLYSYVMPQAIRDMVDEYINCEDIAMNFLVSHITRKPPIKVTSRWTF   857

151  RCPGCPQALSHDDSHFHERHKCINFFVKVYGYMPLLYTQFRVDSVLFKTR   200
     |||||||||||||||||||||||||||||||||||||||||||||||||
858  RCPGCPQALSHDDSHFHERHKCINFFVKVYGYMPLLYTQFRVDSVLFKTR   907

201  LPHDKTKCFKFI   212
     ||||||||||||
908  LPHDKTKCFKFI   919
```

Sequence name: EXL3_HUMAN (SEQ ID NO:1436)
Sequence documentation:
Alignment of: M79217_PEA__1_P8 (SEQ ID NO:1339) x EXL3_HUMAN (SEQ ID NO:1436) ..
Alignment segment 1/1:

Quality: 7947.00
Escore: 0

-continued

| Matching length: | 807 | Total length: | 807 |
|---|---|---|---|
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MTGYTMLRNGGAGNGGQTCMLRWSNRIRLTWLSFTLFVILVFFPLIAHYY    50
     |||||||||||||||||||||||||||||||||||||||||||||||||
  1  MTGYTMLRNGGAGNGGQTCMLRWSNRIRLTWLSFTLFVILVFFPLIAHYY    50

51  LTTLDEADEAGKRIFGPRVGNELCEVKHVLDLCRIRESVSEELLQLEAKR   100
     |||||||||||||||||||||||||||||||||||||||||||||||||
 51  LTTLDEADEAGKRIFGPRVGNELCEVKHVLDLCRIRESVSEELLQLEAKR   100

101  QELNSEIAKLNLKIEACKKSIENAKQDLLQLKNVISQTEHSYKELMAQNQ   150
     |||||||||||||||||||||||||||||||||||||||||||||||||
101  QELNSEIAKLNLKIEACKKSIENAKQDLLQLKNVISQTEHSYKELMAQNQ   150

151  PKLSLPIRLLPEKDDAGLPPPKATRGCRLHNCFDYSRCPLTSGFPVYVYD   200
     |||||||||||||||||||||||||||||||||||||||||||||||||
151  PKLSLPIRLLPEKDDAGLPPPKATRGCRLHNCFDYSRCPLTSGFPVYVYD   200

201  SDQFVFGSYLDPLVKQAFQATARANVYVTENADIACLYVILVGEMQEPVV   250
     |||||||||||||||||||||||||||||||||||||||||||||||||
201  SDQFVFGSYLDPLVKQAFQATARANVYVTENADIACLYVILVGEMQEPVV   250

251  LRPAELEKQLYSLPHWRTDGHNHVIINLSRKSDTQNLLYNVSTGRAMVAQ   300
     |||||||||||||||||||||||||||||||||||||||||||||||||
251  LRPAELEKQLYSLPHWRTDGHNHVIINLSRKSDTQNLLYNVSTGRAMVAQ   300

301  STFYTVQYRPGFDLVVSPLVHAMSEPNFMEIPPQVPVKRKYLFTFQGEKI   350
     |||||||||||||||||||||||||||||||||||||||||||||||||
301  STFYTVQYRPGFDLVVSPLVHAMSEPNFMEIPPQVPVKRKYLFTFQGEKI   350

351  ESLRSSLQEARSFEEEMEGDPPADYDDRIIATLKAVQDSKLDQVLVEFTC   400
     |||||||||||||||||||||||||||||||||||||||||||||||||
351  ESLRSSLQEARSFEEEMEGDPPADYDDRIIATLKAVQDSKLDQVLVEFTC   400

401  KNQPKPSLPTEWALCGEREDRLELLKLSTFALIITPGDPRLVISSGCATR   450
     |||||||||||||||||||||||||||||||||||||||||||||||||
401  KNQPKPSLPTEWALCGEREDRLELLKLSTFALIITPGDPRLVISSGCATR   450

451  LFEALEVGAVPVVLGEQVQLPYQDMLQWNEAALVVPKPRVTEVHFLLRSL   500
     |||||||||||||||||||||||||||||||||||||||||||||||||
451  LFEALEVGAVPVVLGEQVQLPYQDMLQWNEAALVVPKPRVTEVHFLLRSL   500
```

-continued

```
501  SDSDLLAMRRQGRFLWETYFSTADSIFNTVLAMIRTRIQIPAAPIREEAA  550
     ||||||||||||||||||||||||||||||||||||||||||||||||||
501  SDSDLLAMRRQGRFLWETYFSTADSIFNTVLAMIRTRIQIPAAPIREEAA  550

551  AEIPHRSGKAAGTDPNMADNGDLDLGPVETEPPYASPRYLRNFTLTVTDF   600
     |||||||||||||||||||||||||||||||||||||||||||||||||
551  AEIPHRSGKAAGTDPNMADNGDLDLGPVETEPPYASPRYLRNFTLTVTDF   600

601  YRSWNCAPGPFHLFPHTPFDPVLPSEAKFLGSGTGFRPIGGGAGGSGKEF   650
     |||||||||||||||||||||||||||||||||||||||||||||||||
601  YRSWNCAPGPFHLFPHTPFDPVLPSEAKFLGSGTGFRPIGGGAGGSGKEF   650

651  QAALGGNVPREQFTVVMLTYEREEVLMNSLERLNGLPYLNKVVVVWNSPK   700
     |||||||||||||||||||||||||||||||||||||||||||||||||
651  QAALGGNVPREQFTVVMLTYEREEVLMNSLERLNGLPYLNKVVVVWNSPK   700

701  LPSEDLLWPDIGVPIMVVRTEKNSLNNRFLPWNEIETEAILSIDDDAHLR   750
     |||||||||||||||||||||||||||||||||||||||||||||||||
701  LPSEDLLWPDIGVPIMVVRTEKNSLNNRFLPWNEIETEAILSIDDDAHLR   750

751  HDEIMFGFRVWREARDRIVGFPGRYHAWDIPHQSWLYNSNYSCELSMVLT   800
     |||||||||||||||||||||||||||||||||||||||||||||||||
751  HDEIMFGFRVWREARDRIVGFPGRYHAWDIPHQSWLYNSNYSCELSMVLT   800

801  GAAFFHK                                             807
     |||||||
801  GAAFFHK                                             807
```

Description for Cluster M62096

Cluster M62096 features 9 transcript(s) and 42 segment(s) of interest, the names for which are given in Tables 627 and 628, respectively, the sequences themselves are given at the end of the application. The selected protein variants are given in table 629.

TABLE 627

Transcripts of interest

| Transcript Name | Sequence ID No. |
|---|---|
| M62096_PEA_1_T4 | 65 |
| M62096_PEA_1_T5 | 66 |
| M62096_PEA_1_T6 | 67 |
| M62096_PEA_1_T7 | 68 |
| M62096_PEA_1_T9 | 69 |
| M62096_PEA_1_T11 | 70 |
| M62096_PEA_1_T13 | 71 |
| M62096_PEA_1_T14 | 72 |
| M62096_PEA_1_T15 | 73 |

TABLE 628

Segments of interest

| Segment Name | Sequene ID No. |
|---|---|
| M62096_PEA_1_node_0 | 616 |
| M62096_PEA_1_node_2 | 617 |
| M62096_PEA_1_node_15 | 618 |
| M62096_PEA_1_node_17 | 619 |
| M62096_PEA_1_node_19 | 620 |
| M62096_PEA_1_node_23 | 621 |
| M62096_PEA_1_node_27 | 623 |
| M62096_PEA_1_node_29 | 624 |
| M62096_PEA_1_node_31 | 625 |
| M62096_PEA_1_node_34 | 626 |
| M62096_PEA_1_node_36 | 627 |
| M62096_PEA_1_node_38 | 628 |
| M62096_PEA_1_node_40 | 629 |
| M62096_PEA_1_node_48 | 630 |
| M62096_PEA_1_node_50 | 631 |

TABLE 628-continued

Segments of interest

| Segment Name | Sequene ID No. |
|---|---|
| M62096_PEA_1_node_56 | 632 |
| M62096_PEA_1_node_60 | 633 |
| M62096_PEA_1_node_65 | 634 |
| M62096_PEA_1_node_69 | 635 |
| M62096_PEA_1_node_71 | 636 |
| M62096_PEA_1_node_1 | 637 |
| M62096_PEA_1_node_4 | 638 |
| M62096_PEA_1_node_6 | 639 |
| M62096_PEA_1_node_7 | 640 |
| M62096_PEA_1_node_9 | 641 |
| M62096_PEA_1_node_11 | 642 |
| M62096_PEA_1_node_13 | 643 |
| M62096_PEA_1_node_21 | 644 |
| M62096_PEA_1_node_25 | 645 |
| M62096_PEA_1_node_33 | 646 |
| M62096_PEA_1_node_42 | 647 |
| M62096_PEA_1_node_44 | 648 |
| M62096_PEA_1_node_47 | 649 |
| M62096_PEA_1_node_51 | 650 |
| M62096_PEA_1_node_53 | 651 |
| M62096_PEA_1_node_55 | 652 |
| M62096_PEA_1_node_58 | 653 |
| M62096_PEA_1_node_62 | 654 |
| M62096_PEA_1_node_66 | 655 |
| M62096_PEA_1_node_67 | 656 |
| M62096_PEA_1_node_68 | 657 |
| M62096_PEA_1_node_70 | 658 |

TABLE 629

Proteins of interest

| Protein Name | Sequence ID No. | Corresponding Transcript(s) |
|---|---|---|
| M62096_PEA_1_P4 | 1341 | M62096_PEA_1_T6 (SEQ ID NO: 67) |
| M62096_PEA_1_P5 | 1342 | M62096_PEA_1_T7 (SEQ ID NO: 68) |

TABLE 629-continued

Proteins of interest

| Protein Name | Sequence ID No. | Corresponding Transcript(s) |
|---|---|---|
| M62096_PEA_1_P3 | 1343 | M62096_PEA_1_T9 (SEQ ID NO: 69) |
| M62096_PEA_1_P7 | 1344 | M62096_PEA_1_T11 (SEQ ID NO: 70) |
| M62096_PEA_1_P8 | 1345 | M62096_PEA_1_T13 (SEQ ID NO: 71) |
| M62096_PEA_1_P9 | 1346 | M62096_PEA_1_T14 (SEQ ID NO: 72) |
| M62096_PEA_1_P10 | 1347 | M62096_PEA_1_T15 (SEQ ID NO: 73) |
| M62096_PEA_1_P11 | 1348 | M62096_PEA_1_T4 (SEQ ID NO: 65) |
| M62096_PEA_1_P12 | 1349 | M62096_PEA_1_T5 (SEQ ID NO: 66) |

These sequences are variants of the known protein Kinesin heavy chain isoform 5C (SwissProt accession identifier KF5C_HUMAN; known also according to the synonyms Kinesin heavy chain neuron-specific 2), SEQ ID NO:1438, referred to herein as the previously known protein.

Protein Kinesin heavy chain isoform 5C (SEQ ID NO:1438) is known or believed to have the following function(s): Kinesin is a microtubule-associated force-producing protein that may play a role in organelle transport. The sequence for protein Kinesin heavy chain isoform 5C is given at the end of the application, as "Kinesin heavy chain isoform 5C amino acid sequence". Known polymorphisms for this sequence are as shown in Table 630.

TABLE 630

Amino acid mutations for Known Protein

| SNP position(s) on amino acid sequence | Comment |
|---|---|
| 355-360 | TLKNVI -> STHASV |
| 583-585 | EFT -> DRV |

The following GO Annotation(s) apply to the previously known protein. The following annotation(s) were found: organelle organization and biogenesis, which are annotation(s) related to Biological Process; microtubule motor; ATP binding, which are annotation(s) related to Molecular Function; and kinesin, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

As noted above, cluster M62096 features 9 transcript(s), which were listed in Table 1 above. These transcript(s) encode for protein(s) which are variant(s) of protein Kinesin heavy chain isoform 5C (SEQ ID NO:1438). A description of each variant protein according to the present invention is now provided.

Variant protein M62096_PEA_1_P4 (SEQ ID NO:1341) according to the present invention has an amino acid sequence as given at the end of the application; it is encoded by transcript(s) M62096_PEA_1_T6 (SEQ ID NO:67). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P4 (SEQ ID NO:1341) and KF5C_HUMAN (SEQ ID NO:1438):

1. An isolated chimeric polypeptide encoding for M62096_PEA_1_P4 (SEQ ID NO:1341), comprising a first amino acid sequence being at least 70%, optionally at least 80%, preferably at least 85%, more preferably at least 90% and most preferably at least 95% homologous to a polypeptide having the sequence MATYIH (SEQ ID NO:1726) corresponding to amino acids 1-6 of M62096_PEA_1_P4 (SEQ ID NO:1341), and a second amino acid sequence being at least 90% homologous to VSKTGAEGAVLDEAKNINK-SLSALGNVISALAEGTKTHVPYRDSK-MTRILQDSLGGNC RTTIVICCSPSVFNEAETKSTLMF-GQRAKTIKNTVSVNLELTAEEWKKKYEKEKEKNKT LKNVIQHLEMELNRWRNGEAVPED-EQISAKDQKNLEPCDNTPIIDNIAPVVAGISTEEKE KYDEEISSLYRQLDDKDDEIN-QQSQLAEKLKQQMLDQDELLASTR-RDYEKIQEELTRLQ IENEAAKDEVKEVLQA-LEELAVNYDQKSQEVEDKTRANEQLTDELAQKTTTL TTTQRE LSQLQELSNHQKKRATEILN-LLLKDLGEIGGIIGTNDVKTLAD-VNGVIEEEFTMARLYIS KMKSEVKSLVNRSKQLE-SAQMDSNRKMNASERELAACQLLISQHEAKIKSLTD YMQN MEQKRRQLEESQDSLSEELAKLRAQEKM-HEVSFQDKEKEHLTRLQDAEEMKKALEQQ MESHREAHQKQLSRLRDEIEEKQKII-DEIRDLNQKLQLEQEKLSSDYNKLKIEDQEREM KLE-KLLLLNDKREQAREDLKGLEETVS-RELQTLHNLRKLFVQDLTTRVKKSVELDNDD GGGSAAQKQKISFLENNLEQLTKVH-KQLVRDNADLRCELPKLEKRLRATAERVKALES ALKEAKENAM-RDRKRYQQEVDRIKEAVRAKNMARRAH-SAQIAKPIRPGHYPASSPTA VHAIRGGGGSSSN-STHYQK corresponding to amino acids 239-957 of KF5C_HUMAN (SEQ ID NO:1438), which also corresponds to amino acids 7-725 of M62096_PEA_1_P4 (SEQ ID NO:1341), wherein said first amino acid sequence and second amino acid sequence are contiguous and in a sequential order.

2. An isolated polypeptide encoding for a head of M62096_PEA_1_P4 (SEQ ID NO:1341), comprising a polypeptide being at least 70%, optionally at least about 80%, preferably at least about 85%, more preferably at least about 90% and most preferably at least about 95% homologous to the sequence MATYIH (SEQ ID NO:1726) of M62096_PEA_1_P4 (SEQ ID NO:1341).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P4 (SEQ ID NO:1341) is encoded by the following transcript(s): M62096_PEA_1_T6 (SEQ ID NO:67), for which the sequence(s) is/are given at the end of the application. The coding portion of transcript M62096_PEA_1_T6 (SEQ ID NO:67) is shown in bold; this coding portion starts at position 108 and ends at position 2282. The transcript also has the following SNPs as listed in Table 631 (given according to their position on the nucleotide sequence, with the alternative nucleic acid listed; the last column indicates whether the SNP is known or not; the presence of known SNPs in variant protein M62096_PEA_1_P4 (SEQ ID NO:1341) sequence provides support for the deduced sequence of this variant protein according to the present invention).

TABLE 631

| Nucleic acid SNPs | | |
| --- | --- | --- |
| SNP position on nucleotide sequence | Alternative nucleic acid | Previously known SNP? |
| 5757 | G -> T | No |

Variant protein M62096_PEA_1_P5 (SEQ ID NO:1342) according to the present invention has an amino acid sequence as given at the end of the application; it is encoded by transcript(s) M62096_PEA_1_T7 (SEQ ID NO:68). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P5 (SEQ ID NO:1342) and KF5C_HUMAN (SEQ ID NO:1438):

1. An isolated chimeric polypeptide encoding for M62096_PEA_1_P5 (SEQ ID NO:1342), comprising a first amino acid sequence being at least 90% homologous to MTRILQDSLGGNCRTTIVICCSPS-VFNEAETKSTLMFGQRAKTIKNTVSVNLELTAEEWK KKYEKEKEKNKTLKNVIQHLEMELNR-WRNGEAVPEDEQISAKDQKNLEPCDNTPIIDNI APV-VAGISTEEKEKYDEEISSLYRQLDDKD-DEINQQSQLAEKLKQQMLDQDELLASTRR DYEKIQEELTRLQIENEAAKDEVKEV-LQALEELAVNYDQKSQEVEDKTRANEQLTDEL AQKTTTLTTTQRELSQLQELSN-HQKKRATEILNLLLKDLGEIGGIIGTNDVKTLADVNG VIEEEFTMARLYISKMKSEVKSLVNR-SKQLESAQMDSNRKMNASERELAACQLLISQHE AKIKSLTDYMQNMEQKRRQLEESQDSL-SEELAKLRAQEKMHEVSFQDKEKEHLTRLQ DAEEMKKALEQQMESHREAHQKQLSRLR-DEIEEKQKIIDEIRDLNQKLQLEQEKLSSDY NKLK-IEDQEREMKLEKLLLLND-KREQAREDLKGLEETVSRELQTLHNLRKLFVQDLTT RVKKSVELDNDDGGGSAAQKQKIS-FLENNLEQLTKVHKQLVRDNADLRCELPKLEKRL RATAERVKALESALKEAKENAM-RDRKRYQQEVDRIKEAVRAKNMARRAHSAQIAKPI RPGHYPASSPTAVHAIRGGGGSSSNSTHYQK corresponding to amino acids 284-957 of KF5C_HUMAN (SEQ ID NO:1438), which also corresponds to amino acids 1-674 of M62096_PEA_1_P5 (SEQ ID NO:1342).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P5 (SEQ ID NO:1342) is encoded by the following transcript(s): M62096_PEA_1_T7 (SEQ ID NO:68), for which the sequence(s) is/are given at the end of the application. The coding portion of transcript M62096_PEA_1_T7 (SEQ ID NO:68) is shown in bold; this coding portion starts at position 283 and ends at position 2304. The transcript also has the following SNPs as listed in Table 632 (given according to their position on the nucleotide sequence, with the alternative nucleic acid listed; the last column indicates whether the SNP is known or not; the presence of known SNPs in variant protein M62096_PEA_1_P5 (SEQ ID NO:1342) sequence provides support for the deduced sequence of this variant protein according to the present invention).

TABLE 632

| Nucleic acid SNPs | | |
| --- | --- | --- |
| SNP position on nucleotide sequence | Alternative nucleic acid | Previously known SNP? |
| 5779 | G -> T | No |

Variant protein M62096_PEA_1_P3 (SEQ ID NO:1343) according to the present invention has an amino acid sequence as given at the end of the application; it is encoded by transcript(s) M62096_PEA_1_T9 (SEQ ID NO:69). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P3 (SEQ ID NO:1343) and KF5C_HUMAN (SEQ ID NO:1438):

1. An isolated chimeric polypeptide encoding for M62096_PEA_1_P3 (SEQ ID NO:1343), comprising a first amino acid sequence being at least 90% homologous to MEL-NRWRNGEAVPEDEQISAKDQKN-LEPCDNTPIIDNIAPVVAGISTEEKEKYDEEISSL YRQLDDKDDEINQQSQLAEK-LKQQMLDQDELLASTRRDYEKIQEELTR-LQIENEAAKD EVKEVLQALEELAVNYDQKSQEVED-KTRANEQLTDELAQKTTTLTTTQRELSQLQELS NHQKKRATEILNLLLKDLGEIGGIIGT-NDVKTLADVNGVIEEEFTMARLYISKMKSEVKS LVNRSKQLESAQMDSNRKMNASER-ELAACQLLISQHEAKIKSLTDYMQNMEQKRRQL EESQDSLSEELAKLRAQEKMHEVSFQD-KEKEHLTRLQDAEEMKKALEQQMESHREAH QKQLSRLRDEIEEKQKIIDEIRDLN-QKLQLEQEKLSSDYNKLKIEDQEREMKLEKLLLLN DKREQAREDLKGLEETVSRELQTLHNL-RKLFVQDLTTRVKKSVELDNDDGGGSAAQK QKIS-FLENNLEQLTKVHKQLVRDNADLR-CELPKLEKRLRATAERVKALESALKEAKEN AMRDRKRYQQEVDRIKEAVRAKNMAR-RAHSAQIAKPIRPGHYPASSPTAVHAIRGGGG SSSN-STHYQK corresponding to amino acids 365-957 of KF5C_HUMAN (SEQ ID NO:1438), which also corresponds to amino acids 1-593 of M62096_PEA_1_P3 (SEQ ID NO:1343).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P3 (SEQ ID NO:1343) is encoded by the following transcript(s): M62096_PEA_1_T9 (SEQ ID NO:69), for which the sequence(s) is/are given at the end of the application. The coding portion of transcript M62096_PEA_1_T9 (SEQ ID NO:69) is shown in bold; this coding portion starts at position 565 and ends at position 2343. The transcript also has the following SNPs as listed in Table 633 (given according to their position on the nucleotide sequence, with the alternative nucleic acid listed; the last column indicates whether the SNP is known or not; the presence of known SNPs in variant protein M62096_PEA_1_P3 (SEQ ID NO:1343) sequence provides support for the deduced sequence of this variant protein according to the present invention).

TABLE 633

| Nucleic acid SNPs | | |
|---|---|---|
| SNP position on nucleotide sequence | Alternative nucleic acid | Previously known SNP? |
| 5818 | G -> T | No |

Variant protein M62096_PEA_1_P7 (SEQ ID NO:1344) according to the present invention has an amino acid sequence as given at the end of the application; it is encoded by transcript(s) M62096_PEA_1_T11 (SEQ ID NO:70). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P7 (SEQ ID NO:1344) and KF5C_HUMAN (SEQ ID NO:1438):

1. An isolated chimeric polypeptide encoding for M62096_PEA_1_P7 (SEQ ID NO:1344), comprising a first amino acid sequence being at least 70%, optionally at least 80%, preferably at least 85%, more preferably at least 90% and most preferably at least 95% homologous to a polypeptide having the sequence MTQNFRLMWNILLFPLNFS (SEQ ID NO:1727) corresponding to amino acids 1-19 of M62096_PEA_1_P7 (SEQ ID NO:1344), and a second amino acid sequence being at least 90% homologous to LNQKLQLEQEKLSSDYNKLKIEDQER-EMKLEKLLLLNDKREQAREDLKGLEETVSREL QTLHNLRKLFVQDLTTRVKKS-VELDNDDGGGSAAQKQKISFLENN-LEQLTKVHKQLVR DNADLRCELPKLEKRLRA-TAERVKALESALKEAKENAMRDRKRYQQEVDRIKE AVRA KNMARRAHSAQIAKPIRPGHY-PASSPTAVHAIRGGGGSSSNSTHYQK corresponding to amino acids 738-957 of KF5C_HUMAN (SEQ ID NO:1438), which also corresponds to amino acids 20-239 of M62096_PEA_1_P7 (SEQ ID NO:1344), wherein said first amino acid sequence and second amino acid sequence are contiguous and in a sequential order.

2. An isolated polypeptide encoding for a head of M62096_PEA_1_P7 (SEQ ID NO:1344), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO:1727) of M62096_PEA_1_P7 (SEQ ID NO:1344).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Non-secretory protein,NN:YES) predicts that this protein has a signal peptide.

Variant protein M62096_PEA_1_P7 (SEQ ID NO:1344) is encoded by the following transcript(s): M62096_PEA_1_T11 (SEQ ID NO:70), for which the sequence(s) is/are given at the end of the application. The coding portion of transcript M62096_PEA_1_T11 (SEQ ID NO:70) is shown in bold; this coding portion starts at position 633 and ends at position 1349. The transcript also has the following SNPs as listed in Table 634 (given according to their position on the nucleotide sequence, with the alternative nucleic acid listed; the last column indicates whether the SNP is known or not; the presence of known SNPs in variant protein M62096_PEA_1_P7 (SEQ ID NO:1344) sequence provides support for the deduced sequence of this variant protein according to the present invention).

TABLE 634

| Nucleic acid SNPs | | |
|---|---|---|
| SNP position on nucleotide sequence | Alternative nucleic acid | Previously known SNP? |
| 4824 | G -> T | No |

Variant protein M62096_PEA_1_P8 (SEQ ID NO:1345) according to the present invention has an amino acid sequence as given at the end of the application; it is encoded by transcript(s) M62096_PEA_1_T13 (SEQ ID NO:71). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P8 (SEQ ID NO:1345) and KF5C_HUMAN (SEQ ID NO:1438):

1. An isolated chimeric polypeptide encoding for M62096_PEA_1_P8 (SEQ ID NO:1345), comprising a first amino acid sequence being at least 90% homologous to MADPAECSIKVMCRFRPLNEAEILRGDK-FIPKFKGDETVVIGQGKPYVFDRVLPPNTTQ EQVYNACAKQIVKDVLEGYNGTI-FAYGQTSSGKTHTMEGKLHDPQLMGIIPRIAHDIFD HIYSMDENLEFHIKVSYFEIYLD-KIRDLLDVSKTNLAVHEDKNRVPYVKGCTERFVSSPE EVMDVIDEGKANRHVAVTNMNEHSSRSH-SIFLINIKQENVETEKKLSGKLYLVDLAGSE KVSKT-GAEGAVLDEAKNINKSLSALGNVIS-ALAEGTKTHVPYRDSKMTRILQDSLGGN CRTTIVICCSPSVFNEAETKSTLMF-
GQRAKTIKNTVSVNLELTAEEWKKKYEKEKEKNK
TLKNVIQHLEMELNRWRNGEAVPED-
EQISAKDQKNLEPCDNTPIIDNIAPVVAGISTEEK EKY-
DEEISSLYRQLDDKDDEINQQSQLAEK-
LKQQMLDQDELLASTRRDYEKIQEELTRL
QIENEAAKDEVKEVLQALEELAVNYDQK-
SQEVEDKTRANEQLTDELAQKTTTLTTTQR
ELSQLQELSNHQKKRATEILN-
LLLKDLGEIGGIIGTNDVKTLAD-
VNGVIEEEFTMARLYI SKMKSEVKSLVNRSKQLE-
SAQMDSNRKMNASERELAACQLLISQHEAKIKSLTD
YMQN MEQKRRQLEESQDSLSEELAKLRAQEKM-
HEVSFQDKEKEHLTRLQDAEEMKKALEQQ
MESHREAHQKQLSRLRDEIEEKQKIIDEIR corresponding to amino acids 1-736 of KF5C_HUMAN (SEQ ID NO:1438), which also corresponds to amino acids 1-736 of M62096_PEA_1_P8 (SEQ ID NO:1345), and a second amino acid sequence being at least 70%, optionally at least 80%, preferably at least 85%, more preferably at least 90% and most preferably at least 95% homologous to a polypeptide having the sequence E corresponding to amino acids 737-737 of M62096_PEA_1_P8 (SEQ ID NO:1345), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P8 (SEQ ID NO:1345) also has the following non-silent SNPs (Single Nucleotide Polymorphisms) as listed in Table 635, (given according to their position(s) on the amino acid sequence, with the alternative amino acid(s) listed; the last column indicates whether the SNP is known or not; the presence of known SNPs in variant protein M62096_PEA_1_P8 (SEQ ID NO:1345) sequence provides support for the deduced sequence of this variant protein according to the present invention).

TABLE 635

| Amino acid mutations | | |
|---|---|---|
| SNP position(s) on amino acid sequence | Alternative amino acid(s) | Previously known SNP? |
| 5 | A -> T | Yes |

Variant protein M62096_PEA_1_P8 (SEQ ID NO:1345) is encoded by the following transcript(s): M62096_PEA_1_T13 (SEQ ID NO:71), for which the sequence(s) is/are given at the end of the application. The coding portion of transcript M62096_PEA_1_T13 (SEQ ID NO:71) is shown in bold; this coding portion starts at position 396 and ends at position 2606. The transcript also has the following SNPs as listed in Table 636 (given according to their position on the nucleotide sequence, with the alternative nucleic acid listed; the last column indicates whether the SNP is known or not; the presence of known SNPs in variant protein M62096_PEA_1_P8 (SEQ ID NO:1345) sequence provides support for the deduced sequence of this variant protein according to the present invention).

TABLE 636

| Nucleic acid SNPs | | |
|---|---|---|
| SNP position on nucleotide sequence | Alternative nucleic acid | Previously known SNP? |
| 92 | C -> A | Yes |
| 408 | G -> A | Yes |

Variant protein M62096_PEA_1_P9 (SEQ ID NO:1346) according to the present invention has an amino acid sequence as given at the end of the application; it is encoded by transcript(s) M62096_PEA_1_T14 (SEQ ID NO:72). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P9 (SEQ ID NO:1346) and KF5C_HUMAN (SEQ ID NO:1438):

1. An isolated chimeric polypeptide encoding for M62096_PEA_1_P9 (SEQ ID NO:1346), comprising a first amino acid sequence being at least 90% homologous to MADPAECSIKVMCRFRPLNEAEILRGDK-
FIPKFKGDETVVIGQGKPYVFDRVLPPNTTQ
EQVYNACAKQIVKDVLEGYNGTI-
FAYGQTSSGKTHTMEGKLHDPQLMGIIPRIAHDIFD
HIYSMDENLEFHIKVSYFEIYLD-
KIRDLLDVSKTNLAVHEDKNRVPYVKGCTERFVSSPE
EVMDVIDEGKANRHVAVTNMNEHSSRSH-
SIFLINIKQENVETEKKLSGKLYLVDLAGSE KVSKT-
GAEGAVLDEAKNINKSLSALGNVIS-
ALAEGTKTHVPYRDSKMTRILQDSLGGN
CRTTIVICCSPSVFNEAETKSTLMF-
GQRAKTIKNTVSVNLELTAEEWKKKYEKEKEKNK
TLKNVIQHLEMELNRWRNGEAVPED-
EQISAKDQKNLEPCDNTPIIDNIAPVVAGISTEEK EKY-
DEEISSLYRQLDDKDDEINQQSQLAEK-
LKQQMLDQDE corresponding to amino acids 1-454 of KF5C_HUMAN (SEQ ID NO:1438), which also corresponds to amino acids 1-454 of M62096_PEA_1_P9 (SEQ ID NO:1346), and a second amino acid sequence being at least 70%, optionally at least 80%, preferably at least 85%, more preferably at least 90% and most preferably at least 95% homologous to a polypeptide having the sequence VKNAIY-
FFFHKVLLLLFVVDVCSRNLIGIEAFH-
NYRIMWKFLGRCPFTASYKLIITEFRK (SEQ ID NO:1728) corresponding to amino acids 455-514 of M62096_PEA_1_P9 (SEQ ID NO: 1346), wherein said first amino acid sequence and second amino acid sequence are contiguous and in a sequential order.

2. An isolated polypeptide encoding for a tail of M62096_PEA_1_P9 (SEQ ID NO:1346), comprising a polypeptide being at least 70%, optionally at least about 80%, preferably at least about 85%, more preferably at least about 90% and most preferably at least about 95% homologous to the sequence VKNAIYFFFHKVLLLLFVVDVCSRN-
LIGIEAFHNYRIMWKFLGRCPFTASYKLIITEFRK (SEQ ID NO:1728) in M62096_PEA_1_P9 (SEQ ID NO:1346).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P9 (SEQ ID NO:1346) also has the following non-silent SNPs (Single Nucleotide Polymorphisms) as listed in Table 637, (given according to their position(s) on the amino acid sequence, with the alternative amino acid(s) listed; the last column indicates whether the SNP is known or not; the presence of known SNPs in variant protein M62096_PEA_1_P9 (SEQ ID NO:1346) sequence provides support for the deduced sequence of this variant protein according to the present invention).

TABLE 637

Amino acid mutations

| SNP position(s) on amino acid sequence | Alternative amino acid(s) | Previously known SNP? |
|---|---|---|
| 5 | A -> T | Yes |

Variant protein M62096_PEA_1_P9 (SEQ ID NO:1346) is encoded by the following transcript(s): M62096_PEA_1_T14 (SEQ ID NO:72), for which the sequence(s) is/are given at the end of the application. The coding portion of transcript M62096_PEA_1_T14 (SEQ ID NO:72) is shown in bold; this coding portion starts at position 396 and ends at position 1937. The transcript also has the following SNPs as listed in Table 638 (given according to their position on the nucleotide sequence, with the alternative nucleic acid listed; the last column indicates whether the SNP is known or not; the presence of known SNPs in variant protein M62096_PEA_1_P9 (SEQ ID NO:1346) sequence provides support for the deduced sequence of this variant protein according to the present invention).

TABLE 638

Nucleic acid SNPs

| SNP position on nucleotide sequence | Alternative nucleic acid | Previously known SNP? |
|---|---|---|
| 92 | C -> A | Yes |
| 408 | G -> A | Yes |

Variant protein M62096_PEA_1_P10 (SEQ ID NO:1347) according to the present invention has an amino acid sequence as given at the end of the application; it is encoded by transcript(s) M62096_PEA_1_T15 (SEQ ID NO:73). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P10 (SEQ ID NO:1347) and KF5C_HUMAN (SEQ ID NO:1438):

1. An isolated chimeric polypeptide encoding for M62096_PEA_1_P10 (SEQ ID NO:1347), comprising a first amino acid sequence being at least 70%, optionally at least 80%, preferably at least 85%, more preferably at least 90% and most preferably at least 95% homologous to a polypeptide having the sequence MTQNFRLMWNILLFPLNFS (SEQ ID NO: 1727) corresponding to amino acids 1-19 of M62096_PEA_1_P10 (SEQ ID NO:1347), a second amino acid sequence being at least 90% homologous to LNQKLQLEQEKLSSDYNKLKIEDQER-EMKLEKLLLLNDKREQAREDLKGLEETVSREL QTLHNLRKLFVQDLTTRVKK corresponding to amino acids 738-815 of KF5C_HUMAN (SEQ ID NO:1438), which also corresponds to amino acids 20-97 of M62096_PEA_1_P10 (SEQ ID NO:1347), and a third amino acid sequence being at least 70%, optionally at least 80%, preferably at least 85%, more preferably at least 90% and most preferably at least 95% homologous to a polypeptide having the sequence VSSLCLNGTEKKIKDGREESFS-VEISLA (SEQ ID NO: 1730) corresponding to amino acids 98-125 of M62096_PEA_1_P10 (SEQ ID NO:1347), wherein said first amino acid sequence, second amino acid sequence and third amino acid sequence are contiguous and in a sequential order.

2. An isolated polypeptide encoding for a head of M62096_PEA_1_P10 (SEQ ID NO:1347), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO:1727) of M62096_PEA_1_P10 (SEQ ID NO:1347).

3. An isolated polypeptide encoding for a tail of M62096_PEA_1_P 10 (SEQ ID NO:1347), comprising a polypeptide being at least 70%, optionally at least about 80%, preferably at least about 85%, more preferably at least about 90% and most preferably at least about 95% homologous to the sequence VSSLCLNGTEKKIKDGREESFSVEISLA (SEQ ID NO:1730) in M62096_PEA_1_P10 (SEQ ID NO:1347).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Non-secretory protein,NN:YES) predicts that this protein has a signal peptide.

Variant protein M62096_PEA_1_P10 (SEQ ID NO:1347) is encoded by the following transcript(s): M62096_PEA_1_T15 (SEQ ID NO:73), for which the sequence(s) is/are given at the end of the application. The coding portion of transcript M62096_PEA_1_T15 (SEQ ID NO:73) is shown in bold; this coding portion starts at position 633 and ends at position 1007.

Variant protein M62096_PEA_1_P11 (SEQ ID NO:1348) according to the present invention has an amino acid sequence as given at the end of the application; it is encoded by transcript(s) M62096_PEA_1_T4 (SEQ ID NO:65). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA_1_P11 (SEQ ID NO:1348) and KF5C_HUMAN (SEQ ID NO:1438):

1. An isolated chimeric polypeptide encoding for M62096_PEA_1_P11 (SEQ ID NO:1348), comprising a first amino acid sequence being at least 90% homologous to MADPAECSIKVMCRFRPLNEAEILRGDK- FIPKFKGDETVVIGQGKPYVFDRVLPPNTTQ
EQVYNACAKQIVKDVLEGYNGTI-
FAYGQTSSGKTHTMEGKLHDPQLMGIIPRIAHDIFD
HIYSMDENLEFHIKVSYFEIYLD-
KIRDLLDVSKTNLAVHEDKNRVPYVKGCTERFVSSPE
EVMDVIDEGKANRHVAVTNMNEHSSRSH-
SIFLINIKQENVETEKKLSGKLYLVDLAGSE KVSKT-
GAEGAVLDEAKNINKSLSALGNVIS-
ALAEGTKTHVPYRDSKMTRILQDSLGGN
CRTTIVICCSPSVFNEAETKSTLMF-
GQRAKTIKNTVSVNLELTAEEWKKKYEKEKEKNK
TLKNVIQHLEMELNRWRN corresponding to amino acids 1-372 of KF5C_HUMAN (SEQ ID NO:1438), which also corresponds to amino acids 1-372 of M62096_PEA__1_P11 (SEQ ID NO:1348), and a second amino acid sequence being at least 70%, optionally at least 80%, preferably at least 85%, more preferably at least 90% and most preferably at least 95% homologous to a polypeptide having the sequence DFLAAH-VFGKLLE (SEQ ID NO: 1731) corresponding to amino acids 373-385 of M62096_PEA__1_P11 (SEQ ID NO:1348), wherein said first amino acid sequence and second amino acid sequence are contiguous and in a sequential order.

2. An isolated polypeptide encoding for a tail of M62096_PEA__1_P11 (SEQ ID NO:1348), comprising a polypeptide being at least 70%, optionally at least about 80%, preferably at least about 85%, more preferably at least about 90% and most preferably at least about 95% homologous to the sequence DFLAAHVFGKLLE (SEQ ID NO:1731) in M62096_PEA__1_P11 (SEQ ID NO:1348).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA__1_P11 (SEQ ID NO:1348) also has the following non-silent SNPs (Single Nucleotide Polymorphisms) as listed in Table 639, (given according to their position(s) on the amino acid sequence, with the alternative amino acid(s) listed; the last column indicates whether the SNP is known or not; the presence of known SNPs in variant protein M62096_PEA__1_P11 (SEQ ID NO:1348) sequence provides support for the deduced sequence of this variant protein according to the present invention).

TABLE 639

Amino acid mutations

| SNP position(s) on amino acid sequence | Alternative amino acid(s) | Previously known SNP? |
|---|---|---|
| 5 | A -> T | Yes |

Variant protein M62096_PEA__1_P11 (SEQ ID NO:1348) is encoded by the following transcript(s): M62096_PEA__1_T4 (SEQ ID NO:65), for which the sequence(s) is/are given at the end of the application. The coding portion of transcript M62096_PEA__1_T4 (SEQ ID NO:65) is shown in bold; this coding portion starts at position 396 and ends at position 1550. The transcript also has the following SNPs as listed in Table 640 (given according to their position on the nucleotide sequence, with the alternative nucleic acid listed; the last column indicates whether the SNP is known or not; the presence of known SNPs in variant protein M62096_PEA__1_P111 (SEQ ID NO:1348) sequence provides support for the deduced sequence of this variant protein according to the present invention).

TABLE 640

Nucleic acid SNPs

| SNP position on nucleotide sequence | Alternative nucleic acid | Previously known SNP? |
|---|---|---|
| 92 | C -> A | Yes |
| 408 | G -> A | Yes |
| 6908 | G -> T | No |

Variant protein M62096_PEA__1_P12 (SEQ ID NO:1349) according to the present invention has an amino acid sequence as given at the end of the application; it is encoded by transcript(s) M62096_PEA__1_T5 (SEQ ID NO:66). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison Report Between M62096_PEA__1_P12 (SEQ ID NO:1349) and KF5C_HUMAN (SEQ ID NO:1438):

1. An isolated chimeric polypeptide encoding for M62096_PEA__1_P12 (SEQ ID NO:1349), comprising a first amino acid sequence being at least 90% homologous to MADPAECSIKVMCRFRPLNEAEILRGDK-
FIPKFKGDETVVIGQGKPYVFDRVLPPNTTQ
EQVYNACAKQIVKDVLEGYNGTI-
FAYGQTSSGKTHTMEGKLHDPQLMGIIPRIAHDIFD
HIYSMDENLEFHIKVSYFEIYLD-
KIRDLLDVSKTNLAVHEDKNRVPYVKGCTERFVSSPE
EVMDVIDEGKANRHVAVTNMNEHSSRSH-
SIFLINIKQENVETEKKLSGKLYLVDLAGSE KVSKT-
GAEGAVLDEAKNINKSLSALGNVIS-
ALAEGTKTHVPYRDSKMTRILQDSLGGN
CRTTIVICCSPSVFNEAETKSTLMFGQR corresponding to amino acids 1-323 of KF5C_HUMAN (SEQ ID NO:1438), which also corresponds to amino acids 1-323 of M62096_PEA__1_P12 (SEQ ID NO:1349), and a second amino acid sequence being at least 70%, optionally at least 80%, preferably at least 85%, more preferably at least 90% and most preferably at least 95% homologous to a polypeptide having the sequence V corresponding to amino acids 324-324 of M62096_PEA__1_P12 (SEQ ID NO:1349), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA__1_P12 (SEQ ID NO:1349) also has the following non-silent SNPs (Single Nucleotide Polymorphisms) as listed in Table 641, (given according to their position(s) on the amino acid sequence, with the alternative amino acid(s) listed; the last column indicates whether the SNP is known or not; the presence of known SNPs in variant protein M62096_PEA_1_P12 (SEQ ID NO:1349) sequence provides support for the deduced sequence of this variant protein according to the present invention).

TABLE 641

Amino acid mutations

| SNP position(s) on amino acid sequence | Alternative amino acid(s) | Previously known SNP? |
|---|---|---|
| 5 | A -> T | Yes |

Variant protein M62096_PEA_1_P12 (SEQ ID NO:1349) is encoded by the following transcript(s): M62096_PEA_1_T5 (SEQ ID NO:66), for which the sequence(s) is/are given at the end of the application. The coding portion of transcript M62096_PEA_1_T5 (SEQ ID NO:66) is shown in bold; this coding portion starts at position 378 and ends at position 1349. The transcript also has the following SNPs as listed in Table 642 (given according to their position on the nucleotide sequence, with the alternative nucleic acid listed; the last column indicates whether the SNP is known or not; the presence of known SNPs in variant protein M62096_PEA_1_P12 (SEQ ID NO:1349) sequence provides support for the deduced sequence of this variant protein according to the present invention).

TABLE 642

Nucleic acid SNPs

| SNP position on nucleotide sequence | Alternative nucleic acid | Previously known SNP? |
|---|---|---|
| 92 | C -> A | Yes |
| 390 | G -> A | Yes |
| 6784 | G -> T | No |

As noted above, cluster M62096 features 42 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster M62096_PEA_1_node_0 (SEQ ID NO:616) according to the present invention is supported by 14 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 643 below describes the starting and ending position of this segment on each transcript.

TABLE 643

Segment location on transcripts

| Transcript name | Segment starting position | Segment ending position |
|---|---|---|
| M62096_PEA_1_T4 (SEQ ID NO: 65) | 1 | 355 |
| M62096_PEA_1_T5 (SEQ ID NO: 66) | 1 | 355 |
| M62096_PEA_1_T13 (SEQ ID NO: 71) | 1 | 355 |

TABLE 643-continued

Segment location on transcripts

| Transcript name | Segment starting position | Segment ending position |
|---|---|---|
| M62096_PEA_1_T14 (SEQ ID NO: 72) | 1 | 355 |

Segment cluster M62096_PEA_1_node_2 (SEQ ID NO:617) according to the present invention is supported by 12 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 644 below describes the starting and ending position of this segment on each transcript.

TABLE 644

Segment location on transcripts

| Transcript name | Segment starting position | Segment ending position |
|---|---|---|
| M62096_PEA_1_T4 (SEQ ID NO: 65) | 374 | 521 |
| M62096_PEA_1_T5 (SEQ ID NO: 66) | 356 | 503 |
| M62096_PEA_1_T13 (SEQ ID NO: 71) | 374 | 521 |
| M62096_PEA_1_T14 (SEQ ID NO: 72) | 374 | 521 |

Segment cluster M62096_PEA_1_node_15 (SEQ ID NO:618) according to the present invention is supported by 28 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 645 below describes the starting and ending position of this segment on each transcript.

TABLE 645

Segment location on transcripts

| Transcript name | Segment starting position | Segment ending position |
|---|---|---|
| M62096_PEA_1_T4 (SEQ ID NO: 65) | 985 | 1109 |
| M62096_PEA_1_T5 (SEQ ID NO: 66) | 967 | 1091 |
| M62096_PEA_1_T13 (SEQ ID NO: 71) | 985 | 1109 |
| M62096_PEA_1_T14 (SEQ ID NO: 72) | 985 | 1109 |

Segment cluster M62096_PEA_1_node_17 (SEQ ID NO:619) according to the present invention is supported by 1 libraries. The number of libraries was determined as previously described. This segment can be found in the following transcript(s): M62096_PEA_1_T7 (SEQ ID NO:68). Table 646 below describes the starting and ending position of this segment on each transcript.

TABLE 646

Segment location on transcripts

| Transcript name | Segment starting position | Segment ending position |
|---|---|---|
| M62096_PEA_1_T7 (SEQ ID NO: 68) | 1 | 147 |

Segment cluster M62096_PEA_1_node_19 (SEQ ID NO:620) according to the present invention is supported by 3 libraries. The number of libraries was determined as previously described. This segment can be found in the following transcript(s): M62096_PEA_1_T6 (SEQ ID NO:67) and M62096_PEA_1_T9 (SEQ ID NO:69). Table 647 below describes the starting and ending position of this segment on each transcript.

TABLE 647

Segment location on transcripts

| Transcript name | Segment starting position | Segment ending position |
|---|---|---|
| M62096_PEA_1_T6 (SEQ ID NO: 67) | 1 | 125 |
| M62096_PEA_1_T9 (SEQ ID NO: 69) | 1 | 125 |

Segment cluster M62096_PEA_1_node_23 (SEQ ID NO:621) according to the present invention is supported by 36 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 648 below describes the starting and ending position of this segment on each transcript.

TABLE 648

Segment location on transcripts

| Transcript name | Segment starting position | Segment ending position |
|---|---|---|
| M62096_PEA_1_T4 (SEQ ID NO: 65) | 1215 | 1363 |
| M62096_PEA_1_T5 (SEQ ID NO: 66) | 1197 | 1345 |
| M62096_PEA_1_T6 (SEQ ID NO: 67) | 231 | 379 |
| M62096_PEA_1_T7 (SEQ ID NO: 68) | 253 | 401 |
| M62096_PEA_1_T9 (SEQ ID NO: 69) | 231 | 379 |
| M62096_PEA_1_T13 (SEQ ID NO: 71) | 1215 | 1363 |
| M62096_PEA_1_T14 (SEQ ID NO: 72) | 1215 | 1363 |

Segment cluster M62096_PEA_1_node_27 (SEQ ID NO:623) according to the present invention is supported by 35 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 649 below describes the starting and ending position of this segment on each transcript.

TABLE 649

Segment location on transcripts

| Transcript name | Segment starting position | Segment ending position |
|---|---|---|
| M62096_PEA_1_T4 (SEQ ID NO: 65) | 1364 | 1512 |
| M62096_PEA_1_T5 (SEQ ID NO: 66) | 1407 | 1555 |
| M62096_PEA_1_T6 (SEQ ID NO: 67) | 380 | 528 |
| M62096_PEA_1_T7 (SEQ ID NO: 68) | 402 | 550 |
| M62096_PEA_1_T9 (SEQ ID NO: 69) | 441 | 589 |
| M62096_PEA_1_T13 (SEQ ID NO: 71) | 1364 | 1512 |
| M62096_PEA_1_T14 (SEQ ID NO: 72) | 1364 | 1512 |

Segment cluster M62096_PEA_1_node_29 (SEQ ID NO:624) according to the present invention is supported by 1 libraries. The number of libraries was determined as previously described. This segment can be found in the following transcript(s): M62096_PEA_1_T4 (SEQ ID NO:65). Table 650 below describes the starting and ending position of this segment on each transcript.

TABLE 650

Segment location on transcripts

| Transcript name | Segment starting position | Segment ending position |
|---|---|---|
| M62096_PEA_1_T4 (SEQ ID NO: 65) | 1513 | 1679 |

Segment cluster M62096_PEA_1_node_31 (SEQ ID NO:625) according to the present invention is supported by 24 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 651 below describes the starting and ending position of this segment on each transcript.

TABLE 651

Segment location on transcripts

| Transcript name | Segment starting position | Segment ending position |
|---|---|---|
| M62096_PEA_1_T4 (SEQ ID NO: 65) | 1680 | 1855 |
| M62096_PEA_1_T5 (SEQ ID NO: 66) | 1556 | 1731 |
| M62096_PEA_1_T6 (SEQ ID NO: 67) | 529 | 704 |
| M62096_PEA_1_T7 (SEQ ID NO: 68) | 551 | 726 |
| M62096_PEA_1_T9 (SEQ ID NO: 69) | 590 | 765 |
| M62096_PEA_1_T13 (SEQ ID NO: 71) | 1513 | 1688 |
| M62096_PEA_1_T14 (SEQ ID NO: 72) | 1513 | 1688 |

Segment cluster M62096_PEA_1_node_34 (SEQ ID NO:626) according to the present invention is supported by 3 libraries. The number of libraries was determined as previously described. This segment can be found in the following transcript(s): M62096_PEA_1_T14 (SEQ ID NO:72). Table 652 below describes the starting and ending position of this segment on each transcript.

TABLE 652

Segment location on transcripts

| Transcript name | Segment starting position | Segment ending position |
|---|---|---|
| M62096_PEA_1_T14 (SEQ ID NO: 72) | 1758 | 2261 |

Segment cluster M62096_PEA_1_node_36 (SEQ ID NO:627) according to the present invention is supported by 26 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 653 below describes the starting and ending position of this segment on each transcript.

TABLE 653

Segment location on transcripts

| Transcript name | Segment starting position | Segment ending position |
|---|---|---|
| M62096_PEA_1_T4 (SEQ ID NO: 65) | 1925 | 2131 |
| M62096_PEA_1_T5 (SEQ ID NO: 66) | 1801 | 2007 |
| M62096_PEA_1_T6 (SEQ ID NO: 67) | 774 | 980 |
| M62096_PEA_1_T7 (SEQ ID NO: 68) | 796 | 1002 |
| M62096_PEA_1_T9 (SEQ ID NO: 69) | 835 | 1041 |
| M62096_PEA_1_T13 (SEQ ID NO: 71) | 1758 | 1964 |

Segment cluster M62096_PEA_1_node_38 (SEQ ID NO:628) according to the present invention is supported by 24 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 654 below describes the starting and ending position of this segment on each transcript.

TABLE 654

Segment location on transcripts

| Transcript name | Segment starting position | Segment ending position |
|---|---|---|
| M62096_PEA_1_T4 (SEQ ID NO: 65) | 2132 | 2278 |
| M62096_PEA_1_T5 (SEQ ID NO: 66) | 2008 | 2154 |
| M62096_PEA_1_T6 (SEQ ID NO: 67) | 981 | 1127 |
| M62096_PEA_1_T7 (SEQ ID NO: 68) | 1003 | 1149 |
| M62096_PEA_1_T9 (SEQ ID NO: 69) | 1042 | 1188 |
| M62096_PEA_1_T13 (SEQ ID NO: 71) | 1965 | 2111 |

Segment cluster M62096_PEA_1_node_40 (SEQ ID NO:629) according to the present invention is supported by 21 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 655 below describes the starting and ending position of this segment on each transcript.

TABLE 655

Segment location on transcripts

| Transcript name | Segment starting position | Segment ending position |
|---|---|---|
| M62096_PEA_1_T4 (SEQ ID NO: 65) | 2279 | 2467 |
| M62096_PEA_1_T5 (SEQ ID NO: 66) | 2155 | 2343 |
| M62096_PEA_1_T6 (SEQ ID NO: 67) | 1128 | 1316 |
| M62096_PEA_1_T7 (SEQ ID NO: 68) | 1150 | 1338 |
| M62096_PEA_1_T9 (SEQ ID NO: 69) | 1189 | 1377 |
| M62096_PEA_1_T13 (SEQ ID NO: 71) | 2112 | 2300 |

Segment cluster M62096_PEA_1_node_48 (SEQ ID NO:630) according to the present invention is supported by 7 libraries. The number of libraries was determined as previously described. This segment can be found in the following transcript(s): M62096_PEA_1_T13 (SEQ ID NO:71). Table 656 below describes the starting and ending position of this segment on each transcript.

TABLE 656

Segment location on transcripts

| Transcript name | Segment starting position | Segment ending position |
|---|---|---|
| M62096_PEA_1_T13 (SEQ ID NO: 71) | 2606 | 2945 |

Segment cluster M62096_PEA_1_node_50 (SEQ ID NO:631) according to the present invention is supported by 3 libraries. The number of libraries was determined as previously described. This segment can be found in the following transcript(s): M62096_PEA_1_T11 (SEQ ID NO:70) and M62096_PEA_1_T15 (SEQ ID NO:73). Table 657 below describes the starting and ending position of this segment on each transcript.

TABLE 657

Segment location on transcripts

| Transcript name | Segment starting position | Segment ending position |
|---|---|---|
| M62096_PEA_1_T11 (SEQ ID NO: 70) | 1 | 688 |
| M62096_PEA_1_T15 (SEQ ID NO: 73) | 1 | 688 |

Segment cluster M62096_PEA_1_node_56 (SEQ ID NO:632) according to the present invention is supported by 1 libraries. The number of libraries was determined as previously described. This segment can be found in the following transcript(s): M62096_PEA_1_T15 (SEQ ID NO:73). Table 658 below describes the starting and ending position of this segment on each transcript.

TABLE 658

Segment location on transcripts

| Transcript name | Segment starting position | Segment ending position |
|---|---|---|
| M62096_PEA_1_T15 (SEQ ID NO: 73) | 924 | 1059 |

Segment cluster M62096_PEA_1_node_60 (SEQ ID NO:633) according to the present invention is supported by 13 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 659 below describes the starting and ending position of this segment on each transcript.

TABLE 659

Segment location on transcripts

| Transcript name | Segment starting position | Segment ending position |
|---|---|---|
| M62096_PEA_1_T4 (SEQ ID NO: 65) | 3113 | 3329 |
| M62096_PEA_1_T5 (SEQ ID NO: 66) | 2989 | 3205 |
| M62096_PEA_1_T6 (SEQ ID NO: 67) | 1962 | 2178 |
| M62096_PEA_1_T7 (SEQ ID NO: 68) | 1984 | 2200 |
| M62096_PEA_1_T9 (SEQ ID NO: 69) | 2023 | 2239 |
| M62096_PEA_1_T11 (SEQ ID NO: 70) | 1029 | 1245 |

Segment cluster M62096_PEA_1_node_65 (SEQ ID NO:634) according to the present invention is supported by 51 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 660 below describes the starting and ending position of this segment on each transcript.

TABLE 660

Segment location on transcripts

| Transcript name | Segment starting position | Segment ending position |
|---|---|---|
| M62096_PEA_1_T4 (SEQ ID NO: 65) | 3444 | 4763 |
| M62096_PEA_1_T5 (SEQ ID NO: 66) | 3320 | 4639 |
| M62096_PEA_1_T6 (SEQ ID NO: 67) | 2293 | 3612 |
| M62096_PEA_1_T7 (SEQ ID NO: 68) | 2315 | 3634 |
| M62096_PEA_1_T9 (SEQ ID NO: 69) | 2354 | 3673 |
| M62096_PEA_1_T11 (SEQ ID NO: 70) | 1360 | 2679 |

Segment cluster M62096_PEA_1_node_69 (SEQ ID NO:635) according to the present invention is supported by 85 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 661 below describes the starting and ending position of this segment on each transcript.

TABLE 661

Segment location on transcripts

| Transcript name | Segment starting position | Segment ending position |
|---|---|---|
| M62096_PEA_1_T4 (SEQ ID NO: 65) | 4894 | 5826 |
| M62096_PEA_1_T5 (SEQ ID NO: 66) | 4770 | 5702 |
| M62096_PEA_1_T6 (SEQ ID NO: 67) | 3743 | 4675 |
| M62096_PEA_1_T7 (SEQ ID NO: 68) | 3765 | 4697 |
| M62096_PEA_1_T9 (SEQ ID NO: 69) | 3804 | 4736 |
| M62096_PEA_1_T11 (SEQ ID NO: 70) | 2810 | 3742 |

Segment cluster M62096_PEA_1_node_71 (SEQ ID NO:636) according to the present invention is supported by 178 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 662 below describes the starting and ending position of this segment on each transcript.

TABLE 662

Segment location on transcripts

| Transcript name | Segment starting position | Segment ending position |
|---|---|---|
| M62096_PEA_1_T4 (SEQ ID NO: 65) | 5882 | 7128 |
| M62096_PEA_1_T5 (SEQ ID NO: 66) | 5758 | 7004 |
| M62096_PEA_1_T6 (SEQ ID NO: 67) | 4731 | 5977 |
| M62096_PEA_1_T7 (SEQ ID NO: 68) | 4753 | 5999 |
| M62096_PEA_1_T9 (SEQ ID NO: 69) | 4792 | 6038 |
| M62096_PEA_1_T11 (SEQ ID NO: 70) | 3798 | 5044 |

According to an optional embodiment of the present invention, short segments related to the above cluster are also provided. These segments are up to about 120 bp in length, and so are included in a separate description.

Segment cluster M62096_PEA_1_node_1 (SEQ ID NO:637) according to the present invention can be found in the following transcript(s): M62096_PEA_1_T4 (SEQ ID NO:65), M62096_PEA_1_T13 (SEQ ID NO:71) and M62096_PEA_1_T14 (SEQ ID NO:72). Table 663 below describes the starting and ending position of this segment on each transcript.

TABLE 663

Segment location on transcripts

| Transcript name | Segment starting position | Segment ending position |
|---|---|---|
| M62096_PEA_1_T4 (SEQ ID NO: 65) | 356 | 373 |
| M62096_PEA_1_T13 (SEQ ID NO: 71) | 356 | 373 |
| M62096_PEA_1_T14 (SEQ ID NO: 72) | 356 | 373 |

Segment cluster M62096_PEA_1_node_4 (SEQ ID NO:638) according to the present invention is supported by 12 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 664 below describes the starting and ending position of this segment on each transcript.

TABLE 664

Segment location on transcripts

| Transcript name | Segment starting position | Segment ending position |
|---|---|---|
| M62096_PEA_1_T4 (SEQ ID NO: 65) | 522 | 612 |
| M62096_PEA_1_T5 (SEQ ID NO: 66) | 504 | 594 |
| M62096_PEA_1_T13 (SEQ ID NO: 71) | 522 | 612 |
| M62096_PEA_1_T14 (SEQ ID NO: 72) | 522 | 612 |

Segment cluster M62096_PEA_1_node_6 (SEQ ID NO:639) according to the present invention is supported by 13 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 665 below describes the starting and ending position of this segment on each transcript.

TABLE 665

Segment location on transcripts

| Transcript name | Segment starting position | Segment ending position |
|---|---|---|
| M62096_PEA_1_T4 (SEQ ID NO: 65) | 613 | 686 |
| M62096_PEA_1_T5 (SEQ ID NO: 66) | 595 | 668 |
| M62096_PEA_1_T13 (SEQ ID NO: 71) | 613 | 686 |
| M62096_PEA_1_T14 (SEQ ID NO: 72) | 613 | 686 |

Segment cluster M62096_PEA_1_node_7 (SEQ ID NO:640) according to the present invention is supported by 19 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 666 below describes the starting and ending position of this segment on each transcript.

TABLE 666

Segment location on transcripts

| Transcript name | Segment starting position | Segment ending position |
|---|---|---|
| M62096_PEA_1_T4 (SEQ ID NO: 65) | 687 | 791 |
| M62096_PEA_1_T5 (SEQ ID NO: 66) | 669 | 773 |
| M62096_PEA_1_T13 (SEQ ID NO: 71) | 687 | 791 |
| M62096_PEA_1_T14 (SEQ ID NO: 72) | 687 | 791 |

Segment cluster M62096_PEA_1_node_9 (SEQ ID NO:641) according to the present invention is supported by 18 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 667 below describes the starting and ending position of this segment on each transcript.

TABLE 667

Segment location on transcripts

| Transcript name | Segment starting position | Segment ending position |
|---|---|---|
| M62096_PEA_1_T4 (SEQ ID NO: 65) | 792 | 840 |
| M62096_PEA_1_T5 (SEQ ID NO: 66) | 774 | 822 |
| M62096_PEA_1_T13 (SEQ ID NO: 71) | 792 | 840 |
| M62096_PEA_1_T14 (SEQ ID NO: 72) | 792 | 840 |

Segment cluster M62096_PEA_1_node_11 (SEQ ID NO:642) according to the present invention is supported by 22 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 668 below describes the starting and ending position of this segment on each transcript.

TABLE 668

Segment location on transcripts

| Transcript name | Segment starting position | Segment ending position |
|---|---|---|
| M62096_PEA_1_T4 (SEQ ID NO: 65) | 841 | 896 |
| M62096_PEA_1_T5 (SEQ ID NO: 66) | 823 | 878 |
| M62096_PEA_1_T13 (SEQ ID NO: 71) | 841 | 896 |
| M62096_PEA_1_T14 (SEQ ID NO: 72) | 841 | 896 |

Segment cluster M62096_PEA_1_node_13 (SEQ ID NO:643) according to the present invention is supported by 24 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 669 below describes the starting and ending position of this segment on each transcript.

TABLE 669

Segment location on transcripts

| Transcript name | Segment starting position | Segment ending position |
|---|---|---|
| M62096_PEA_1_T4 (SEQ ID NO: 65) | 897 | 984 |
| M62096_PEA_1_T5 (SEQ ID NO: 66) | 879 | 966 |
| M62096_PEA_1_T13 (SEQ ID NO: 71) | 897 | 984 |
| M62096_PEA_1_T14 (SEQ ID NO: 72) | 897 | 984 |

Segment cluster M62096_PEA_1_node_21 (SEQ ID NO:644) according to the present invention is supported by 33 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 670 below describes the starting and ending position of this segment on each transcript.

TABLE 670

Segment location on transcripts

| Transcript name | Segment starting position | Segment ending position |
|---|---|---|
| M62096_PEA_1_T4 (SEQ ID NO: 65) | 1110 | 1214 |
| M62096_PEA_1_T5 (SEQ ID NO: 66) | 1092 | 1196 |
| M62096_PEA_1_T6 (SEQ ID NO: 67) | 126 | 230 |
| M62096_PEA_1_T7 (SEQ ID NO: 68) | 148 | 252 |
| M62096_PEA_1_T9 (SEQ ID NO: 69) | 126 | 230 |
| M62096_PEA_1_T13 (SEQ ID NO: 71) | 1110 | 1214 |
| M62096_PEA_1_T14 (SEQ ID NO: 72) | 1110 | 1214 |

Segment cluster M62096_PEA_1_node_25 (SEQ ID NO:645) according to the present invention is supported by 3 libraries. The number of libraries was determined as previously described. This segment can be found in the following transcript(s): M62096_PEA_1_T5 (SEQ ID NO:66) and M62096_PEA_1_T9 (SEQ ID NO:69). Table 671 below describes the starting and ending position of this segment on each transcript.

TABLE 671

Segment location on transcripts

| Transcript name | Segment starting position | Segment ending position |
|---|---|---|
| M62096_PEA 1_T5 (SEQ ID NO: 66) | 1346 | 1406 |
| M62096_PEA 1_T9 (SEQ ID NO: 69) | 380 | 440 |

Segment cluster M62096_PEA_1_node_33 (SEQ ID NO:646) according to the present invention is supported by 20 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 672 below describes the starting and ending position of this segment on each transcript.

TABLE 672

Segment location on transcripts

| Transcript name | Segment starting position | Segment ending position |
|---|---|---|
| M62096_PEA_1_T4 (SEQ ID NO: 65) | 1856 | 1924 |
| M62096_PEA_1_T5 (SEQ ID NO: 66) | 1732 | 1800 |
| M62096_PEA_1_T6 (SEQ ID NO: 67) | 705 | 773 |
| M62096_PEA_1_T7 (SEQ ID NO: 68) | 727 | 795 |
| M62096_PEA_1_T9 (SEQ ID NO: 69) | 766 | 834 |
| M62096_PEA_1_T13 (SEQ ID NO: 71) | 1689 | 1757 |
| M62096_PEA_1_T14 (SEQ ID NO: 72) | 1689 | 1757 |

Segment cluster M62096_PEA_1_node_42 (SEQ ID NO:647) according to the present invention is supported by 17 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 673 below describes the starting and ending position of this segment on each transcript.

TABLE 673

Segment location on transcripts

| Transcript name | Segment starting position | Segment ending position |
|---|---|---|
| M62096_PEA_1_T4 (SEQ ID NO: 65) | 2468 | 2585 |
| M62096_PEA_1_T5 (SEQ ID NO: 66) | 2344 | 2461 |
| M62096_PEA_1_T6 (SEQ ID NO: 67) | 1317 | 1434 |
| M62096_PEA_1_T7 (SEQ ID NO: 68) | 1339 | 1456 |
| M62096_PEA_1_T9 (SEQ ID NO: 69) | 1378 | 1495 |
| M62096_PEA_1_T13 (SEQ ID NO: 71) | 2301 | 2418 |

Segment cluster M62096_PEA_1_node_44 (SEQ ID NO:648) according to the present invention is supported by 19 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 674 below describes the starting and ending position of this segment on each transcript.

TABLE 674

Segment location on transcripts

| Transcript name | Segment starting position | Segment ending position |
|---|---|---|
| M62096_PEA_1_T4 (SEQ ID NO: 65) | 2586 | 2662 |
| M62096_PEA_1_T5 (SEQ ID NO: 66) | 2462 | 2538 |
| M62096_PEA_1_T6 (SEQ ID NO: 67) | 1435 | 1511 |
| M62096_PEA_1_T7 (SEQ ID NO: 68) | 1457 | 1533 |
| M62096_PEA_1_T9 (SEQ ID NO: 69) | 1496 | 1572 |
| M62096_PEA_1_T13 (SEQ ID NO: 71) | 2419 | 2495 |

Segment cluster M62096_PEA_1_node_47 (SEQ ID NO:649) according to the present invention is supported by 21 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 675 below describes the starting and ending position of this segment on each transcript.

TABLE 675

Segment location on transcripts

| Transcript name | Segment starting position | Segment ending position |
|---|---|---|
| M62096_PEA_1_T4 (SEQ ID NO: 65) | 2663 | 2772 |
| M62096_PEA_1_T5 (SEQ ID NO: 66) | 2539 | 2648 |
| M62096_PEA_1_T6 (SEQ ID NO: 67) | 1512 | 1621 |
| M62096_PEA_1_T7 (SEQ ID NO: 68) | 1534 | 1643 |
| M62096_PEA_1_T9 (SEQ ID NO: 69) | 1573 | 1682 |
| M62096_PEA_1_T13 (SEQ ID NO: 71) | 2496 | 2605 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 676.

TABLE 676

Oligonucleotides related to this segment

| Oligonucleotide name | Overexpressed in cancers | Chip reference |
|---|---|---|
| M62096_0_7_0 | lung malignant tumors | LUN |

Segment cluster M62096_PEA_1_node_51 (SEQ ID NO:650) according to the present invention is supported by 11 libraries. The number of libraries was determined as previously described. This segment can be found in the following transcript(s): M62096_PEA_1_T4 (SEQ ID NO:65), M62096 PEA_1_T5 (SEQ ID NO:66), M62096 PEA_1_T6 (SEQ ID NO:67), M62096_PEA_1_T7 (SEQ ID NO:68), M62096_PEA_1_T9 (SEQ ID NO:69), M62096_PEA_1_T11 (SEQ ID NO:70) and M62096_PEA_1_T15 (SEQ ID NO:73). Table 677 below describes the starting and ending position of this segment on each transcript.

TABLE 677

Segment location on transcripts

| Transcript name | Segment starting position | Segment ending position |
|---|---|---|
| M62096_PEA_1_T4 (SEQ ID NO: 65) | 2773 | 2874 |
| M62096_PEA_1_T5 (SEQ ID NO: 66) | 2649 | 2750 |
| M62096_PEA_1_T6 (SEQ ID NO: 67) | 1622 | 1723 |
| M62096_PEA_1_T7 (SEQ ID NO: 68) | 1644 | 1745 |
| M62096_PEA_1_T9 (SEQ ID NO: 69) | 1683 | 1784 |
| M62096_PEA_1_T11 (SEQ ID NO: 70) | 689 | 790 |
| M62096_PEA_1_T15 (SEQ ID NO: 73) | 689 | 790 |

Segment cluster M62096_PEA_1_node_53 (SEQ ID NO:651) according to the present invention is supported by 10 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T11 (SEQ ID NO:70) and M62096_PEA_1_T15 (SEQ ID NO:73). Table 678 below describes the starting and ending position of this segment on each transcript.

TABLE 678

Segment location on transcripts

| Transcript name | Segment starting position | Segment ending position |
|---|---|---|
| M62096_PEA_1_T4 (SEQ ID NO: 65) | 2875 | 2935 |
| M62096_PEA_1_T5 (SEQ ID NO: 66) | 2751 | 2811 |
| M62096_PEA_1_T6 (SEQ ID NO: 67) | 1724 | 1784 |
| M62096_PEA_1_T7 (SEQ ID NO: 68) | 1746 | 1806 |
| M62096_PEA_1_T9 (SEQ ID NO: 69) | 1785 | 1845 |
| M62096_PEA_1_T11 (SEQ ID NO: 70) | 791 | 851 |
| M62096_PEA_1_T15 (SEQ ID NO: 73) | 791 | 851 |

Segment cluster M62096_PEA_1_node_55 (SEQ ID NO:652) according to the present invention is supported by 9 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T11 (SEQ ID NO:70) and M62096_PEA_1_T15 (SEQ ID NO:73). Table 679 below describes the starting and ending position of this segment on each transcript.

TABLE 679

Segment location on transcripts

| Transcript name | Segment starting position | Segment ending position |
|---|---|---|
| M62096_PEA_1_T4 (SEQ ID NO: 65) | 2936 | 3007 |
| M62096_PEA_1_T5 (SEQ ID NO: 66) | 2812 | 2883 |

TABLE 679-continued

Segment location on transcripts

| Transcript name | Segment starting position | Segment ending position |
|---|---|---|
| M62096_PEA_1_T6 (SEQ ID NO: 67) | 1785 | 1856 |
| M62096_PEA_1_T7 (SEQ ID NO: 68) | 1807 | 1878 |
| M62096_PEA_1_T9 (SEQ ID NO: 69) | 1846 | 1917 |
| M62096_PEA_1_T11 (SEQ ID NO: 70) | 852 | 923 |
| M62096_PEA_1_T15 (SEQ ID NO: 73) | 852 | 923 |

Segment cluster M62096_PEA_1_node_58 (SEQ ID NO:653) according to the present invention is supported by 9 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 680 below describes the starting and ending position of this segment on each transcript.

TABLE 680

Segment location on transcripts

| Transcript name | Segment starting position | Segment ending position |
|---|---|---|
| M62096_PEA_1_T4 (SEQ ID NO: 65) | 3008 | 3112 |
| M62096_PEA_1_T5 (SEQ ID NO: 66) | 2884 | 2988 |
| M62096_PEA_1_T6 (SEQ ID NO: 67) | 1857 | 1961 |
| M62096_PEA_1_T7 (SEQ ID NO: 68) | 1879 | 1983 |
| M62096_PEA_1_T9 (SEQ ID NO: 69) | 1918 | 2022 |
| M62096_PEA_1_T11 (SEQ ID NO: 70) | 924 | 1028 |

Segment cluster M62096_PEA_1_node_62 (SEQ ID NO:654) according to the present invention is supported by 14 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 681 below describes the starting and ending position of this segment on each transcript.

TABLE 681

Segment location on transcripts

| Transcript name | Segment starting position | Segment ending position |
|---|---|---|
| M62096_PEA_1_T4 (SEQ ID NO: 65) | 3330 | 3443 |
| M62096_PEA_1_T5 (SEQ ID NO: 66) | 3206 | 3319 |
| M62096_PEA_1_T6 (SEQ ID NO: 67) | 2179 | 2292 |
| M62096_PEA_1_T7 (SEQ ID NO: 68) | 2201 | 2314 |
| M62096_PEA_1_T9 (SEQ ID NO: 69) | 2240 | 2353 |
| M62096_PEA_1_T11 (SEQ ID NO: 70) | 1246 | 1359 |

Segment cluster M62096_PEA_1_node_66 (SEQ ID NO:655) according to the present invention is supported by 23 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 682 below describes the starting and ending position of this segment on each transcript.

TABLE 682

Segment location on transcripts

| Transcript name | Segment starting position | Segment ending position |
|---|---|---|
| M62096_PEA_1_T4 (SEQ ID NO: 65) | 4764 | 4881 |
| M62096_PEA_1_T5 (SEQ ID NO: 66) | 4640 | 4757 |
| M62096_PEA_1_T6 (SEQ ID NO: 67) | 3613 | 3730 |
| M62096_PEA_1_T7 (SEQ ID NO: 68) | 3635 | 3752 |
| M62096_PEA_1_T9 (SEQ ID NO: 69) | 3674 | 3791 |
| M62096_PEA_1_T11 (SEQ ID NO: 70) | 2680 | 2797 |

Segment cluster M62096_PEA_1_node_67 (SEQ ID NO:656) according to the present invention can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 683 below describes the starting and ending position of this segment on each transcript.

TABLE 683

Segment location on transcripts

| Transcript name | Segment starting position | Segment ending position |
|---|---|---|
| M62096_PEA_1_T4 (SEQ ID NO: 65) | 4882 | 4887 |
| M62096_PEA_1_T5 (SEQ ID NO: 66) | 4758 | 4763 |
| M62096_PEA_1_T6 (SEQ ID NO: 67) | 3731 | 3736 |
| M62096_PEA_1_T7 (SEQ ID NO: 68) | 3753 | 3758 |
| M62096_PEA_1_T9 (SEQ ID NO: 69) | 3792 | 3797 |
| M62096_PEA_1_T11 (SEQ ID NO: 70) | 2798 | 2803 |

Segment cluster M62096_PEA_1_node_68 (SEQ ID NO:657) according to the present invention can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 684 below describes the starting and ending position of this segment on each transcript.

TABLE 684

Segment location on transcripts

| Transcript name | Segment starting position | Segment ending position |
|---|---|---|
| M62096_PEA_1_T4 (SEQ ID NO: 65) | 4888 | 4893 |
| M62096_PEA_1_T5 (SEQ ID NO: 66) | 4764 | 4769 |
| M62096_PEA_1_T6 (SEQ ID NO: 67) | 3737 | 3742 |
| M62096_PEA_1_T7 (SEQ ID NO: 68) | 3759 | 3764 |
| M62096_PEA_1_T9 (SEQ ID NO: 69) | 3798 | 3803 |
| M62096_PEA_1_T11 (SEQ ID NO: 70) | 2804 | 2809 |

Segment cluster M62096_PEA_1_node_70 (SEQ ID NO:658) according to the present invention is supported by 55 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 685 below describes the starting and ending position of this segment on each transcript.

TABLE 685

Segment location on transcripts

| Transcript name | Segment starting position | Segment ending position |
|---|---|---|
| M62096_PEA_1_T4 (SEQ ID NO: 65) | 5827 | 5881 |
| M62096_PEA_1_T5 (SEQ ID NO: 66) | 5703 | 5757 |
| M62096_PEA_1_T6 (SEQ ID NO: 67) | 4676 | 4730 |
| M62096_PEA_1_T7 (SEQ ID NO: 68) | 4698 | 4752 |
| M62096_PEA_1_T9 (SEQ ID NO: 69) | 4737 | 4791 |
| M62096_PEA_1_T11 (SEQ ID NO: 70) | 3743 | 3797 |

Variant Protein Alignment to the Previously Known Protein:
Sequence name: KF5C_HUMAN (SEQ ID NO:1438)
Sequence documentation:
Alignment of: M62096_PEA_1_P4 (SEQ ID NO:1341) x KF5C_HUMAN (SEQ ID NO:1438) ..
Alignment segment 1/1:

| | | | |
|---|---|---|---|
| Quality: | 6936.00 | | |
| Escore: | 0 | | |
| Matching length: | 719 | Total length: | 719 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  7 VSKTGAEGAVLDEAKNINKSLSALGNVISALAEGTKTHVPYRDSKMTRIL  56
    |||||||||||||||||||||||||||||||||||||||||||||||||
239 VSKTGAEGAVLDEAKNINKSLSALGNVISALAEGTKTHVPYRDSKMTRIL 288

57 QDSLGGNCRTTIVICCSPSVFNEAETKSTLMFGQRAKTIKNTVSVNLELT 106
    |||||||||||||||||||||||||||||||||||||||||||||||||
289 QDSLGGNCRTTIVICCSPSVFNEAETKSTLMFGQRAKTIKNTVSVNLELT 338

107 AEEWKKKYEKEKEKNKTLKNVIQHLEMELNRWRNGEAVPEDEQISAKDQK 156
    |||||||||||||||||||||||||||||||||||||||||||||||||
339 AEEWKKKYEKEKEKNKTLKNVIQHLEMELNRWRNGEAVPEDEQISAKDQK 388

157 NLEPCDNTPIIDNIAPVVAGISTEEKEKYDEEISSLYRQLDDKDDEINQQ 206
    |||||||||||||||||||||||||||||||||||||||||||||||||
389 NLEPCDNTPIIDNIAPVVAGISTEEKEKYDEEISSLYRQLDDKDDEINQQ 438

207 SQLAEKLKQQMLDQDELLASTRRDYEKIQEELTRLQIENEAAKDEVKEVL 256
    |||||||||||||||||||||||||||||||||||||||||||||||||
439 SQLAEKLKQQMLDQDELLASTRRDYEKIQEELTRLQIENEAAKDEVKEVL 488

257 QALEELAVNYDQKSQEVEDKTRANEQLTDELAQKTTTLTTTQRELSQLQE 306
    |||||||||||||||||||||||||||||||||||||||||||||||||
489 QALEELAVNYDQKSQEVEDKTRANEQLTDELAQKTTTLTTTQRELSQLQE 538

307 LSNGQKKRATEILNLLLKDLGEIGGIIGTNDVKTLADVNGVIEEEFTMAR 356
    |||||||||||||||||||||||||||||||||||||||||||||||||
539 LSNGQKKRATEILNLLLKDLGEIGGIIGTNDVKTLADVNGVIEEEFTMAR 588

357 LYISKMKSEVKSLVNRSKQLESAQMDSNRKMNASERELAACQLLISQHEA 406
    |||||||||||||||||||||||||||||||||||||||||||||||||
589 LYISKMKSEVKSLVNRSKQLESAQMDSNRKMNASERELAACQLLISQHEA 638

407 KIKSLTDYMQNMEQKRRQLEESQDSLSEELAKLRAQEKMHEVSFQDKEKE 456
    |||||||||||||||||||||||||||||||||||||||||||||||||
639 KIKSLTDYMQNMEQKRRQLEESQDSLSEELAKLRAQEKMHEVSFQDKEKE 688
```

```
457 HLTRLQDAEEMKKALEQQMESHREAHQKQLSRLRDEIEEKQKIIDEIRDL 506
    ||||||||||||||||||||||||||||||||||||||||||||||||||
689 HLTRLQDAEEMKKALEQQMESHREAHQKQLSRLRDEIEEKQKIIDEIRDL 738

507 NQKLQLEQEKLSSDYNKLKIEDQEREMKLEKLLLLNDKREQAREDLKGLE 556
    ||||||||||||||||||||||||||||||||||||||||||||||||||
739 NQKLQLEQEKLSSDYNKLKIEDQEREMKLEKLLLLNDKREQAREDLKGLE 788

557 ETVSRELQTLHNLRKLFVQDLTTRVKKSVELDNDDGGGSAAQKQKISFLE 606
    ||||||||||||||||||||||||||||||||||||||||||||||||||
789 ETVSRELQTLHNLRKLFVQDLTTRVKKSVELDNDDGGGSAAQKQKISFLE 838

607 NNLEQLTKVHKQLVRDNADLRCELPKLEKRLRATAERVKALESALKEAKE 656
    ||||||||||||||||||||||||||||||||||||||||||||||||||
839 NNLEQLTKVHKQLVRDNADLRCELPKLEKRLRATAERVKALESALKEAKE 888

657 NAMRDRKRYQQEVDRIKEAVRAKNMARRAHSAQIAKPIRPGHYPASSPTA 706
    ||||||||||||||||||||||||||||||||||||||||||||||||||
889 NAMRDRKRYQQEVDRIKEAVRAKNMARRAHSAQIAKPIRPGHYPASSPTA 938

707 VHAIRGGGGSSSNSTHYQK                               725
    |||||||||||||||||||
939 VHAIRGGGGSSSNSTHYQK                               957
```

Sequence name: KF5C_HUMAN (SEQ ID NO:1438)
Sequence documentation:
Alignment of: M62096_PEA_1_P5 (SEQ ID NO:1342) x KF5C_HUMAN (SEQ ID NO:1438) ..
Alignment segment 1/1:

Quality:      6520.00
Escore:       0

| | | | |
|---|---|---|---|
| Matching length: | 674 | Total length: | 674 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MTRILQDSLGGNCRTTIVICCSPSVFNEAETKSTLMFGQRAKTIKNTVSV  50
    ||||||||||||||||||||||||||||||||||||||||||||||||||
284 MTRILQDSLGGNCRTTIVICCSPSVFNEAETKSTLMFGQRAKTIKNTVSV 333

51 NLELTAEEWKKKYEKEKEKNKTLKNVIQHLEMELNRWRNGEAVPEDEQIS 100
    ||||||||||||||||||||||||||||||||||||||||||||||||||
334 NLELTAEEWKKKYEKEKEKNKTLKNVIQHLEMELNRWRNGEAVPEDEQIS 383

101 AKDQKNLEPCDNTPIIDNIAPVVAGISTEEKEKYDEEISSLYRQLDDKDD 150
    ||||||||||||||||||||||||||||||||||||||||||||||||||
384 AKDQKNLEPCDNTPIIDNIAPVVAGISTEEKEKYDEEISSLYRQLDDKDD 433

151 EINQQSQLAEKLKQQMLDQDELLASTRRDYEKIQEELTRLQIENEAAKDE 200
    ||||||||||||||||||||||||||||||||||||||||||||||||||
434 EINQQSQLAEKLKQQMLDQDELLASTRRDYEKIQEELTRLQIENEAAKDE 483

201 VKEVLQALEELAVNYDQKSQEVEDKTRANEQLTDELAQKTTTLTTTQREL 250
    ||||||||||||||||||||||||||||||||||||||||||||||||||
484 VKEVLQALEELAVNYDQKSQEVEDKTRANEQLTDELAQKTTTLTTTQREL 533

251 SQLQELSNHQKKRATEILNLLLKDLGEIGGIIGTNDVKTLADVNGVIEEE 300
    ||||||||||||||||||||||||||||||||||||||||||||||||||
534 SQLQELSNHQKKRATEILNLLLKDLGEIGGIIGTNDVKTLADVNGVIEEE 583

301 FTMARLYISKMKSEVKSLVNRSKQLESAQMDSNRKMNASERELAACQLLI 350
    ||||||||||||||||||||||||||||||||||||||||||||||||||
584 FTMARLYISKMKSEVKSLVNRSKQLESAQMDSNRKMNASERELAACQLLI 633

351 SQHEAKIKSLTDYMQNMEQKRRQLESSQDSLSEELAKLRAQEKMHEVSFQ 400
    ||||||||||||||||||||||||||||||||||||||||||||||||||
634 SQHEAKIKSLTDYMQNMEQKRRQLESSQDSLSEELAKLRAQEKMHEVSFQ 683

401 DKEKEHLTRLQDAEEMKKALEQQMESHREAHQKQLSRLRDEIEEKQKIID 450
    ||||||||||||||||||||||||||||||||||||||||||||||||||
684 DKEKEHLTRLQDAEEMKKALEQQMESHREAHQKQLSRLRDEIEEKQKIID 733
```

```
451 EIRDLNQKLQLEQEKLSSDYNKLKIEDQEREMKLEKLLLLNDKREQARED 500
    ||||||||||||||||||||||||||||||||||||||||||||||||||
734 EIRDLNQKLQLEQEKLSSDYNKLKIEDQEREMKLEKLLLLNDKREQARED 783

501 LKGLEETVSRELQTLHNLRKLFVQDLTTRVKKSVELDNDDGGGSAAQKQK 550
    ||||||||||||||||||||||||||||||||||||||||||||||||||
784 LKGLEETVSRELQTLHNLRKLFVQDLTTRVKKSVELDNDDGGGSAAQKQK 833

551 ISFLENNLEQLTKVHKQLVRDNADLRCELPKLEKRLRATAERVKALESAL 600
    ||||||||||||||||||||||||||||||||||||||||||||||||||
834 ISFLENNLEQLTKVHKQLVRDNADLRCELPKLEKRLRATAERVKALESAL 883

601 KEAKENAMRDRKRYQQEVDRIKEAVRAKNMARRAHSAQIAKPIRPGHYPA 650
    ||||||||||||||||||||||||||||||||||||||||||||||||||
884 KEAKENAMRDRKRYQQEVDRIKEAVRAKNMARRAHSAQIAKPIRPGHYPA 933

651 SSPTAVHAIRGGGGSSSNSTHYQK                          674
    ||||||||||||||||||||||||
934 SSPTAVHAIRGGGGSSSNSTHYQK                          957
```

Sequence name: KF5C_HUMAN (SEQ ID NO:1438)
Sequence documentation:
Alignment of: M62096_PEA_1_P3 (SEQ ID NO:1343) x KF5C_HUMAN (SEQ ID NO:1438) ..
Alignment segment 1/1:

| | |
|---|---|
| Quality: | 5726.00 |
| Escore: | 0 |
| Matching length: | 593 |
| Total length: | 593 |
| Matching Percent Similarity: | 100.00 |
| Matching Percent Identity: | 100.00 |
| Total Percent Similarity: | 100.00 |
| Total Percent Identity: | 100.00 |
| Gaps: | 0 |

Alignment:

```
  1 MELNRWRNGEAVPEDEQISAKDQKNLEPCDNTPIIDNIAPVVAGISTEEK 50
    ||||||||||||||||||||||||||||||||||||||||||||||||||
365 MELNRWRNGEAVPEDEQISAKDQKNLEPCDNTPIIDNIAPVVAGISTEEK 414

51 EKYDEEISSLYRQLDDKDDEINQQSQLAEKLKQQMLDQDELLASTRRDYE 100
    ||||||||||||||||||||||||||||||||||||||||||||||||||
415 EKYDEEISSLYRQLDDKDDEINQQSQLAEKLKQQMLDQDELLASTRRDYE 464

101 KIQEELTRLQIENEAAKDEVKEVLQALEELAVNYDQKSQEVEDKTRANEQ 150
    ||||||||||||||||||||||||||||||||||||||||||||||||||
465 KIQEELTRLQIENEAAKDEVKEVLQALEELAVNYDQKSQEVEDKTRANEQ 514

151 LTDELAQKTTTLTTTQRELSQLQELSNHQKKRATEILNLLLKDLGEIGGI 200
    ||||||||||||||||||||||||||||||||||||||||||||||||||
515 LTDELAQKTTTLTTTQRELSQLQELSNHQKKRATEILNLLLKDLGEIGGI 564

201 IGTNDVKTLADVNGVIEEEFTMARLYISKMKSEVKSLVNRSKQLESAQMD 250
    ||||||||||||||||||||||||||||||||||||||||||||||||||
565 IGTNDVKTLADVNGVIEEEFTMARLYISKMKSEVKSLVNRSKQLESAQMD 614

251 SNRKMNASERELAACQLLIAQHEAKIKSLTDYMQNMEQKRRQLEESQDSL 300
    ||||||||||||||||||||||||||||||||||||||||||||||||||
615 SNRKMNASERELAACQLLIAQHEAKIKSLTDYMQNMEQKRRQLEESQDSL 664

301 SEELAKLRAQEKMHEVSFQDKEKEHLTRLQDAEEMKKALEQQMESHREAH 350
    ||||||||||||||||||||||||||||||||||||||||||||||||||
665 SEELAKLRAQEKMHEVSFQDKEKEHLTRLQDAEEMKKALEQQMESHREAH 714

351 QKQLSRLRDEIEEKQKIIDEIRDLNQKLQLEQEKLSSDYNKLKIEDQERE 400
    ||||||||||||||||||||||||||||||||||||||||||||||||||
715 QKQLSRLRDEIEEKQKIIDEIRDLNQKLQLEQEKLSSDYNKLKIEDQERE 764

401 MKLEKLLLLNDKREQAREDLKGLEETVSRELQTLHNLRKLFVQDLTTRVK 450
    ||||||||||||||||||||||||||||||||||||||||||||||||||
765 MKLEKLLLLNDKREQAREDLKGLEETVSRELQTLHNLRKLFVQDLTTRVK 814
```

-continued

```
451 KSVELDNDDGGGSAAQKQKISFLENNLEQLTKVHKQLVRDNADLRCELPK 500
    ||||||||||||||||||||||||||||||||||||||||||||||||||
815 KSVELDNDDGGGSAAQKQKISFLENNLEQLTKVHKQLVRDNADLRCELPK 864

501 LEKRLRATAERVKALESALKEAKENAMRDRKRYQQEVDRIDEAVRAKNMA 550
    ||||||||||||||||||||||||||||||||||||||||||||||||||
865 LEKRLRATAERVKALESALKEAKENAMRDRKRYQQEVDRIDEAVRAKNMA 914

551 RRAHSAQIAKPIRPGHYPASSPTAVHAIRGGGGSSSNSTHYQK         593
    ||||||||||||||||||||||||||||||||||||||||||
915 KSVELDNDDGGGSAAQKQKISFLENNLEQLTKVHKQLVRDNAD         957
```

Sequence name: KF5C_HUMAN (SEQ ID NO:1438)
Sequence documentation:
Alignment of: M62096_PEA_1_P7 (SEQ ID NO:1344) x KF5C_HUMAN (SEQ ID NO:1438)..
Alignment segment 1/1:

| | | |
|---|---|---|
| Quality: | 2117.00 | |
| Escore: | 0 | |
| Matching length: | 220 | Total length: 220 |
| Matching Percent Similarity: | 100.00 | Matching Percent Identity: 100.00 |
| Total Percent Similarity: | 100.00 | Total Percent Identity: 100.00 |
| Gaps: | 0 | |

Alignment:

Sequence documentation:
Alignment of: M62096_PEA_1_P8 (SEQ ID NO:1345) x KF5C_HUMAN (SEQ ID NO:1438)..
Alignment segment 1/1:

| | | |
|---|---|---|
| Quality: | 7146.00 | |
| Escore: | 0 | |
| Matching length: | 737 | Total length: 737 |
| Matching Percent Similarity: | 100.00 | Matching Percent Identity: 99.86 |
| Total Percent Similarity: | 100.00 | Total Percent Identity: 99.86 |
| Gaps: | 0 | |

Alignment:

```
 20 LNQKLQLEQEKLSSDYNKLKIEDQEREMKLEKLLLLNDKREQAREDLKGL  69
    ||||||||||||||||||||||||||||||||||||||||||||||||||
738 LNQKLQLEQEKLSSDYNKLKIEDQEREMKLEKLLLLNDKREQAREDLKGL 787

70 EETVSRELQTLHNLRKLFVQDLTTRVKKSVELDNDDGGGSAAQKQKISFL 119
    ||||||||||||||||||||||||||||||||||||||||||||||||||
788 EETVSRELQTLHNLRKLFVQDLTTRVKKSVELDNDDGGGSAAQKQKISFL 837

120 ENNLEQLTKVHKQLVRDNADLRCELPKLEKRLRATAERVKALESALKEAK 169
    ||||||||||||||||||||||||||||||||||||||||||||||||||
838 ENNLEQLTKVHKQLVRDNADLRCELPKLEKRLRATAERVKALESALKEAK 887

170 ENAMRDRKRYQQEVDRIDEAVRAKNMARRAHSAQIAKPIRPGHYPASSPT 219
    ||||||||||||||||||||||||||||||||||||||||||||||||||
888 ENAMRDRKRYQQEVDRIDEAVRAKNMARRAHSAQIAKPIRPGHYPASSPT 937

220 AVHAIRGGGGSSSNSTHYQK                               239
    ||||||||||||||||||||
938 AVHAIRGGGGSSSNSTHYQK                               957
```

Sequence name: KF5C_HUMAN (SEQ ID NO:1438)

```
  1 MADPAECSIKVMCRFRPLNEAEILRGDKFIPKFKGDETVVIGQGKPYVFD  50
    ||||||||||||||||||||||||||||||||||||||||||||||||||
  1 MADPAECSIKVMCRFRPLNEAEILRGDKFIPKFKGDETVVIGQGKPYVFD  50

51 RVLPPNTTQEQVYNACAKQIVKDVLEGYNGTIFAYGQTSSGKTHTMEGKL 100
    ||||||||||||||||||||||||||||||||||||||||||||||||||
 51 RVLPPNTTQEQVYNACAKQIVKDVLEGYNGTIFAYGQTSSGKTHTMEGKL 100

101 HDPQLMGIIPRIAHDIFDHIYSMDENLEFHIKVSYFEIYLDKIRDLLDVS 150
    ||||||||||||||||||||||||||||||||||||||||||||||||||
101 HDPQLMGIIPRIAHDIFDHIYSMDENLEFHIKVSYFEIYLDKIRDLLDVS 150
```

-continued

```
151 KTNLAVHEDKNRVPYVKGCTERFVSSPEEVMDVIDEGKANRHVAVTNMNE 200
    ||||||||||||||||||||||||||||||||||||||||||||||||||
151 KTNLAVHEDKNRVPYVKGCTERFVSSPEEVMDVIDEGKANRHVAVTNMNE 200

201 HSSRSHSIFLINIKQENVETEKKLSGKLYLVDLAGSEKVSKTGAEGAVLD 250
    ||||||||||||||||||||||||||||||||||||||||||||||||||
201 HSSRSHSIFLINIKQENVETEKKLSGKLYLVDLAGSEKVSKTGAEGAVLD 250

251 EAKNINKSLSALGNVISALAEGTKTHVPYRDSKMTRILQDSLGGNCRTTI 300
    ||||||||||||||||||||||||||||||||||||||||||||||||||
251 EAKNINKSLSALGNVISALAEGTKTHVPYRDSKMTRILQDSLGGNCRTTI 300

301 VICCSPSVFNEAETKSTLMFGQRAKTIKNTVSVNLELTAEEWKKKYEKEK 350
    ||||||||||||||||||||||||||||||||||||||||||||||||||
301 VICCSPSVFNEAETKSTLMFGQRAKTIKNTVSVNLELTAEEWKKKYEKEK 350

351 EKNKTLKNVIQHLEMELNRWRNGEAVPEDEQISAKDQKNLEPCDNTPIID 400
    ||||||||||||||||||||||||||||||||||||||||||||||||||
351 EKNKTLKNVIQHLEMELNRWRNGEAVPEDEQISAKDQKNLEPCDNTPIID 400

401 NIAPVVAGISTEEKEKYDEEISSLYRQLDDKDDEINQQSQLAEKLKQQML 450
    ||||||||||||||||||||||||||||||||||||||||||||||||||
401 NIAPVVAGISTEEKEKYDEEISSLYRQLDDKDDEINQQSQLAEKLKQQML 450

451 DQDELLASTRRDYEKIQEELTRLQIENEAAKDEVKEVLQALEELAVNYDQ 500
    ||||||||||||||||||||||||||||||||||||||||||||||||||
451 DQDELLASTRRDYEKIQEELTRLQIENEAAKDEVKEVLQALEELAVNYDQ 500

501 KSQEVEDKTRANEQLTDELAQKTTTLTTTQRELSQLQELSNHQKKRATEI 550
    ||||||||||||||||||||||||||||||||||||||||||||||||||
501 KSQEVEDKTRANEQLTDELAQKTTTLTTTQRELSQLQELSNHQKKRATEI 550

551 LNLLLKDLGEIGGIIGTNDVKTLADVNGVIEEEFTMARLYISKMKSEVKS 600
    ||||||||||||||||||||||||||||||||||||||||||||||||||
551 LNLLLKDLGEIGGIIGTNDVKTLADVNGVIEEEFTMARLYISKMKSEVKS 600

601 LVNRSKQLESAQMDSNRKMNASERELAACQLLISQHEAKIKSLTDYMQNM 650
    ||||||||||||||||||||||||||||||||||||||||||||||||||
601 LVNRSKQLESAQMDSNRKMNASERELAACQLLISQHEAKIKSLTDYMQNM 650

651 EQKRRQLEESQDSLSEELAKLRAQEKMHEVSFQDKEKEHLTRLQDAEEMK 700
    ||||||||||||||||||||||||||||||||||||||||||||||||||
651 EQKRRQLEESQDSLSEELAKLRAQEKMHEVSFQDKEKEHLTRLQDAEEMK 700

701 DALEQQMESHREAHQKQLSRLRDEIEEKQKIIDEIRE              737
    |||||||||||||||||||||||||||||||||||:
701 DALEQQMESHREAHQKQLSRLRDEIEEKQKIIDEIRE              737
```

Sequence name: KF5C_HUMAN (SEQ ID NO:1438)
Sequence documentation:
Alignment of: M62096_PEA__1_P9 (SEQ ID NO:1346) x KF5C_HUMAN (SEQ ID NO:1438) ..
Alignment segment 1/1:

Quality:       4434.00
Escore:        0

| | | | |
|---|---|---|---|
| Matching length: | 454 | Total length: | 454 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MADPAECSIKVMCRFRPLNEAEILRGDKFIPKFKGDETVVIGQGKPYVFD 50
    ||||||||||||||||||||||||||||||||||||||||||||||||||
  1 MADPAECSIKVMCRFRPLNEAEILRGDKFIPKFKGDETVVIGQGKPYVFD 50

51 RVLPPNTTQEQVYNACAKQIVKDVLEGYNGTIFAYGQTSSGKTHTMEGKL 100
    ||||||||||||||||||||||||||||||||||||||||||||||||||
 51 RVLPPNTTQEQVYNACAKQIVKDVLEGYNGTIFAYGQTSSGKTHTMEGKL 100

101 HDPQLMGIIPRIAHDIFDHIYSMDENLEFHIKVSYFEIYLDKIRDLLDVS 150
    ||||||||||||||||||||||||||||||||||||||||||||||||||
101 HDPQLMGIIPRIAHDIFDHIYSMDENLEFHIKVSYFEIYLDKIRDLLDVS 150
```

-continued

```
151 KTNLAVHEDKNRVPYVKGCTERFVSSPEEVMDVIDEGKANRHVAVTNMNE 200
    ||||||||||||||||||||||||||||||||||||||||||||||||||
151 KTNLAVHEDKNRVPYVKGCTERFVSSPEEVMDVIDEGKANRHVAVTNMNE 200

201 HSSRSHSIFLINIKQENVETEKKLSGKLYLVDLAGSEKVSKTGAEGAVLD 250
    ||||||||||||||||||||||||||||||||||||||||||||||||||
201 HSSRSHSIFLINIKQENVETEKKLSGKLYLVDLAGSEKVSKTGAEGAVLD 250

251 EAKNINKSLSALGNVISALAEGTKTHVPYRDSKMTRILQDSLGGNCRTTI 300
    ||||||||||||||||||||||||||||||||||||||||||||||||||
251 EAKNINKSLSALGNVISALAEGTKTHVPYRDSKMTRILQDSLGGNCRTTI 300

301 VICCSPSVFNEAETKSTLMFGQRAKTIKNTVSVNLELTAEEWKKKYEKEK 350
    ||||||||||||||||||||||||||||||||||||||||||||||||||
301 VICCSPSVFNEAETKSTLMFGQRAKTIKNTVSVNLELTAEEWKKKYEKEK 350

351 EKNKTLKNVIQHLEMELNRWRNGEAVPEDEQISAKDQKNLEPCDNTPIID 400
    ||||||||||||||||||||||||||||||||||||||||||||||||||
351 EKNKTLKNVIQHLEMELNRWRNGEAVPEDEQISAKDQKNLEPCDNTPIID 400

401 NIAPVVAGISTEEKEKYDEEISSLYRQLDDKDDEINQQSQLAEKLKQQML 450
    ||||||||||||||||||||||||||||||||||||||||||||||||||
401 NIAPVVAGISTEEKEKYDEEISSLYRQLDDKDDEINQQSQLAEKLKQQML 450

451 DQDE 454
    ||||
451 DQDE 454
```

Sequence name: KF5C_HUMAN (SEQ ID NO:1438)
Sequence documentation:
Alignment of: M62096_PEA_1_P10 (SEQ ID NO:1347) x KF5C_HUMAN (SEQ ID NO:1438) ..
Alignment segment 1/1:

| | |
|---|---|
| Quality: | 747.00 |
| Escore: | 0 |
| Matching length: | 78    Total length: 78 |
| Matching Percent Similarity: | 100.00    Matching Percent Identity: 100.00 |
| Total Percent Similarity: | 100.00    Total Percent Identity: 100.00 |
| Gaps: | 0 |

Alignment:

Alignment of: M62096_PEA_1_P11 (SEQ ID NO:1348) x KF5C_HUMAN (SEQ ID NO:1438) ..
Alignment segment 1/1:

| | |
|---|---|
| Quality: | 3634.00 |
| Escore: | 0 |
| Matching length: | 372    Total length: 372 |
| Matching Percent Similarity: | 100.00    Matching Percent Identity: 100.00 |
| Total Percent Similarity: | 100.00    Total Percent Identity: 100.00 |
| Gaps: | 0 |

Alignment:

```
 20 LNQKLQLEQEKLSSDYNKLKIEDQEREMKLEKLLLLNDKREQAREDLXGL  69
    |||||||||||||||||||||||||||||||||||||||||||||||||
738 LNQKLQLEQEKLSSDYNKLKIEDQEREMKLEKLLLLNDKREQAREDLXGL 787

70 EETVSRELQTLHNLRKLFVQDLTTRVKK  97
    ||||||||||||||||||||||||||||
788 EETVSRELQTLHNLRKLFVQDLTTRVKK 815
```

Sequence name: KF5C_HUMAN (SEQ ID NO:1438)
Sequence documentation:

```
 1 MADPAECSIKVMCRFRPLNEAEILRGDKFIPKFKGDETVVIGQGKPYVFD 50
   |||||||||||||||||||||||||||||||||||||||||||||||||
 1 MADPAECSIKVMCRFRPLNEAEILRGDKFIPKFKGDETVVIGQGKPYVFD 50
```

```
 51 RVLPPNTTQEQVYNACAKQIVKDVLEGYNGTIFAYGQTSSGKTHTMEGKL 100
    |||||||||||||||||||||||||||||||||||||||||||||||||
 51 RVLPPNTTQEQVYNACAKQIVKDVLEGYNGTIFAYGQTSSGKTHTMEGKL 100

101 HDPQLMGIIPRIAHDIFDHIYSMDENLEFHIKVSYFEIYLDKIRDLLDVS 150
    |||||||||||||||||||||||||||||||||||||||||||||||||
101 HDPQLMGIIPRIAHDIFDHIYSMDENLEFHIKVSYFEIYLDKIRDLLDVS 150

151 KTNLAVHEDKNRVPYVKGCTERFVSSPEEVMDVIDEGKANRHVAVTNMNE 200
    |||||||||||||||||||||||||||||||||||||||||||||||||
151 KTNLAVHEDKNRVPYVKGCTERFVSSPEEVMDVIDEGKANRHVAVTNMNE 200

201 HSSRSHSIFLINIKQENVETEKKLSGKLYLVDLAGSEKVSKTGAEGAVLD 250
    |||||||||||||||||||||||||||||||||||||||||||||||||
201 HSSRSHSIFLINIKQENVETEKKLSGKLYLVDLAGSEKVSKTGAEGAVLD 250

251 EAKNINKSLSALGNVISALAEGTKTHVPYRDSKMTRILQDSLGGNCRTTI 300
    |||||||||||||||||||||||||||||||||||||||||||||||||
251 EAKNINKSLSALGNVISALAEGTKTHVPYRDSKMTRILQDSLGGNCRTTI 300

301 VICCSPSVFNEAETKSTLMFGQRAKTIKNTVSVNLELTAEEWKKKYEKEK 350
    |||||||||||||||||||||||||||||||||||||||||||||||||
301 VICCSPSVFNEAETKSTLMFGQRAKTIKNTVSVNLELTAEEWKKKYEKEK 350

351 EKNKTLKNVIQHLEMELNRWRN                             372
    ||||||||||||||||||||||
351 EKNKTLKNVIQHLEMELNRWRN                             372
```

Sequence name: KF5C_HUMAN (SEQ ID NO:1438)
Sequence documentation:
Alignment of: M62096_PEA__1_P12 (SEQ ID NO:1349) x KF5C_HUMAN (SEQ ID NO:1438) ..
Alignment segment 1/1:

Quality:       3145.00
Escore:           0

| Matching length: | 323 | Total length: | 323 |
|---|---|---|---|
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MADPAECSIKVMCRFRPLNEAEILRGDKFIPKFKGDETVVIGQGKPYVFD  50
    |||||||||||||||||||||||||||||||||||||||||||||||||
  1 MADPAECSIKVMCRFRPLNEAEILRGDKFIPKFKGDETVVIGQGKPYVFD  50

51 RVLPPNTTQEQVYNACAKQIVKDVLEGYNGTIFAYGQTSSGKTHTMEGKL 100
    |||||||||||||||||||||||||||||||||||||||||||||||||
 51 RVLPPNTTQEQVYNACAKQIVKDVLEGYNGTIFAYGQTSSGKTHTMEGKL 100

101 HDPQLMGIIPRIAHDIFDHIYSMDENLEFHIKVSYFEIYLDKIRDLLDVS 150
    |||||||||||||||||||||||||||||||||||||||||||||||||
101 HDPQLMGIIPRIAHDIFDHIYSMDENLEFHIKVSYFEIYLDKIRDLLDVS 150

151 KTNLAVHEDKNRVPYVKGCTERFVSSPEEVMDVIDEGKANRHVAVTNMNE 200
    |||||||||||||||||||||||||||||||||||||||||||||||||
151 KTNLAVHEDKNRVPYVKGCTERFVSSPEEVMDVIDEGKANRHVAVTNMNE 200

201 HSSRSHSIFLINIKQENVETEKKLSGKLYLVDLAGSEKVSKTGAEGAVLD 250
    |||||||||||||||||||||||||||||||||||||||||||||||||
201 HSSRSHSIFLINIKQENVETEKKLSGKLYLVDLAGSEKVSKTGAEGAVLD 250

251 EAKNINKSLSALGNVISALAEGTKTHVPYRDSKMTRILQDSLGGNCRTTI 300
    |||||||||||||||||||||||||||||||||||||||||||||||||
251 EAKNINKSLSALGNVISALAEGTKTHVPYRDSKMTRILQDSLGGNCRTTI 300
```

```
301 VICCSPSVFNEAETKSTLMFGQR        323
    |||||||||||||||||||||||
301 VICCSPSVFNEAETKSTLMFGQR        323
```

Expression of *Homo sapiens* Protein Tyrosine Phosphatase, Receptor Type, S (PTPRS) M62069 Transcripts which are Detectable by Amplicon as Depicted in Sequence Name M62069 seg19 (SEQ ID NO: 1657) in Normal and Cancerous Lung Tissues Expression of *Homo sapiens* protein tyrosine phosphatase, receptor type, S (PTPRS) transcripts detectable by or according to seg19, M62069 seg19 amplicon (SEQ ID NO: 1657) and M62069 seg19F (SEQ ID NO:1655) and M62069 seg19R (SEQ ID NO:1656) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 65:
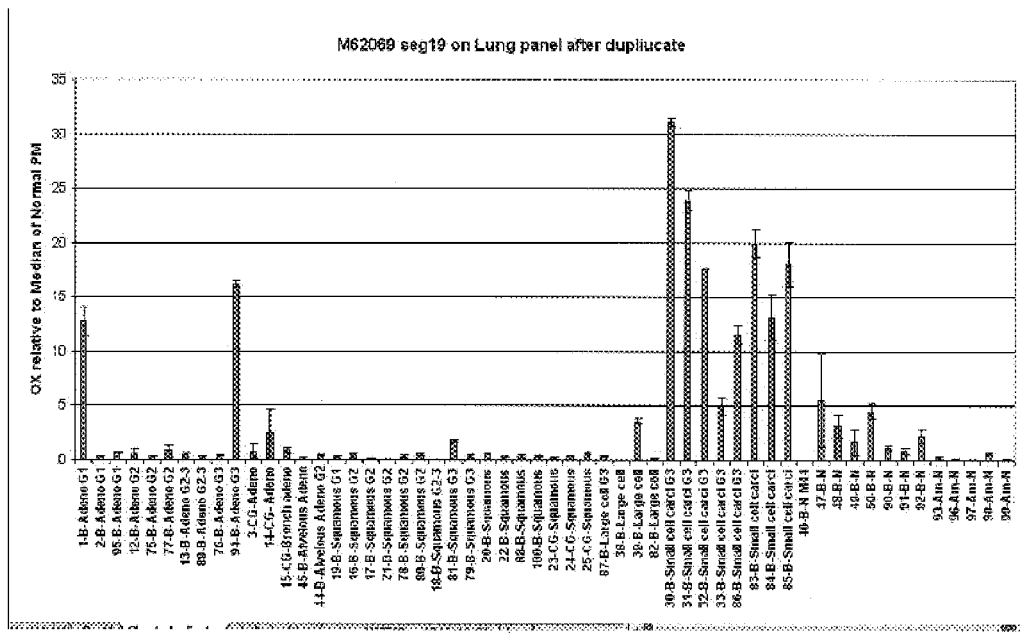
FIG. 65 is a histogram showing over expression of the protein tyrosine phosphatase, receptor type, S (PTPRS) M62069 transcripts, which are detectable by amplicon as depicted in sequence name M62069 seg19 (SEQ ID NO:1657), in cancerous lung samples relative to the normal samples.

FIG. 65 is a histogram showing over expression of the above-indicated *Homo sapiens* protein tyrosine phosphatase, receptor type, S (PTPRS) transcripts in cancerous lung samples relative to the normal samples. Values represent the average of duplicate experiments. Error bars indicate the minimal and maximal values obtained.

As is evident from FIG. 65, the expression of *Homo sapiens* protein tyrosine phosphatase, receptor type, S (PTPRS) transcripts detectable by the above amplicon(s) in cancer samples was significantly higher than in the non-cancerous samples (Sample Nos. 47-50, 90-93, 96-99 Table 2). Notably an over-expression of at least 5 fold was found in 2 out of 15 adenocarcinoma samples, and in 8 out of 8 small cells carcinoma samples.

Primer pairs are also optionally and preferably encompassed within the present invention; for example, for the above experiment, the following primer pair was used as a non-limiting illustrative example only of a suitable primer pair: M62069 seg19F forward primer (SEQ ID NO:1655); and M62069 seg19R reverse primer (SEQ ID NO:1656).

The present invention also preferably encompasses any amplicon obtained through the use of any suitable primer pair; for example, for the above experiment, the following amplicon was obtained as a non-limiting illustrative example only of a suitable amplicon: M62069 seg 19 (SEQ ID NO:1657).

```
Forward primer-M62069 seg19F
                                    (SEQ ID NO:1655)
GCTGATTGTCCCCATGAAGG:

Reverse primer-M62069 seg19
                                    (SEQ ID NO:1656)
```

```
-continued
TGGCATACGGGAACTCAGTG:

Amplicon
                                    (SEQ ID NO:1657)
GCTGATTGTCCCCATGAAGGCCAGCCTTGAAGCTTGGTCAGTCTCCCTAA
CTGTATGATTGATCCCCACTTATTGCACTACATCACTGAGTTC
CCGTATGC:
```

Expression of *Homo sapiens* Protein Tyrosine Phosphatase, Receptor Type, S (PTPRS) M62069 Transcripts which are Detectable by Amplicon as Depicted in Sequence Name M62069 Seg29 (SEQ ID NO:1660) in Normal and Cancerous Lung Tissues Expression of *Homo sapiens* protein tyrosine phosphatase, receptor type, S (PTPRS) transcripts detectable by or according to seg29, M62069 seg29 amplicon (SEQ ID NO:1660) and M62069 seg29F (SEQ ID NO:1658) and M62069 seg29R (SEQ ID NO:1659) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 66:
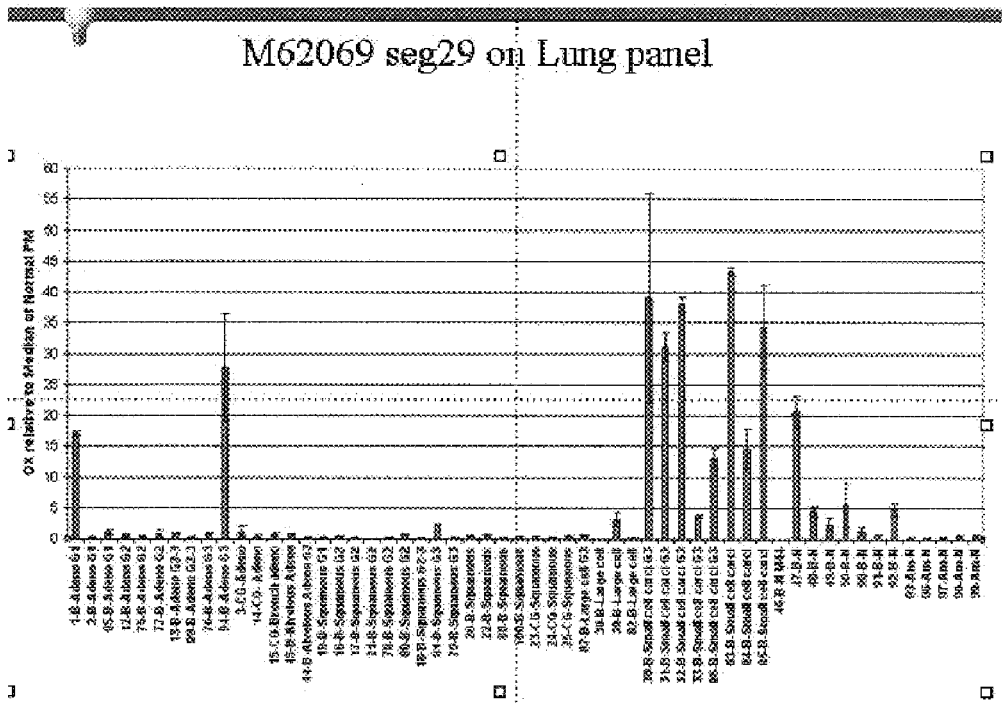
FIG. 66 is a histogram showing over expression of the protein tyrosine phosphatase, receptor type, S (PTPRS) M62069 transcripts, which are detectable by amplicon as depicted in sequence name M62069 seg29 (SEQ ID NO: 1660), in cancerous lung samples relative to the normal samples.

FIG. 66 is a histogram showing over expression of the above-indicated *Homo sapiens* protein tyrosine phosphatase, receptor type, S (PTPRS) transcripts in cancerous lung samples relative to the normal samples. Values represent the average of duplicate experiments. Error bars indicate the minimal and maximal values obtained.

As is evident from FIG. 66, the expression of *Homo sapiens* protein tyrosine phosphatase, receptor type, S (PTPRS) transcripts detectable by the above amplicon(s) in cancer samples was significantly higher than in the non-cancerous samples (Sample Nos. 47-50, 90-93, 96-99 Table 2). Notably an over-expression of at least 5 fold was found in 2 out of 15 adenocarcinoma samples, and in 7 out of 8 small cells carcinoma samples.

Primer pairs are also optionally and preferably encompassed within the present invention; for example, for the above experiment, the following primer pair was used as a non-limiting illustrative example only of a suitable primer pair: M62069 seg29F forward primer (SEQ ID NO:1658); and M62069 seg29R reverse primer (SEQ ID NO:1659).

The present invention also preferably encompasses any amplicon obtained through the use of any suitable primer pair; for example, for the above experiment, the following amplicon was obtained as a non-limiting illustrative example only of a suitable amplicon: M62069 seg29 (SEQ ID NO:1660).

```
Forward primer-
M62069 seg29F:    ATTGAATAATTCAGCACCTGAGGC

Reverse primer-
M62069 seg29R:    TTCATATGGCTACTCCCCACCT

Amplicon:         ATTGAATAATTCAGCACCTGAGGCTGGTGGATGA
                  TTCTTTGCAATTTGGCAGGAATGGGAGAGTCGGG
                  AGCAGTAGTTGGCAAGGTGGGGAGTAGC
                  CATATGAA
```

Description for Cluster M78076

Cluster M78076 features 9 transcript(s) and 35 segment(s) of interest, the names for which are given in Tables 686 and 687, respectively, the sequences themselves are given at the end of the application. The selected protein variants are given in table 688.

TABLE 686

Transcripts of interest

| Transcript Name | Sequence ID No. |
|---|---|
| M78076_PEA_1_T2 | 74 |
| M78076_PEA_1_T3 | 75 |
| M78076_PEA_1_T5 | 76 |
| M78076_PEA_1_T13 | 77 |
| M78076_PEA_1_T15 | 78 |
| M78076_PEA_1_T23 | 79 |
| M78076_PEA_1_T26 | 80 |
| M78076_PEA_1_T27 | 81 |
| M78076_PEA_1_T28 | 82 |

TABLE 687

Segments of interest

| Segment Name | Sequence ID No. |
|---|---|
| M78076_PEA_1_node_0 | 659 |
| M78076_PEA_1_node_10 | 660 |
| M78076_PEA_1_node_15 | 661 |
| M78076_PEA_1_node_18 | 662 |
| M78076_PEA_1_node_20 | 663 |
| M78076_PEA_1_node_24 | 664 |
| M78076_PEA_1_node_26 | 665 |
| M78076_PEA_1_node_29 | 666 |
| M78076_PEA_1_node_32 | 667 |
| M78076_PEA_1_node_35 | 668 |
| M78076_PEA_1_node_37 | 669 |
| M78076_PEA_1_node_46 | 670 |
| M78076_PEA_1_node_47 | 671 |
| M78076_PEA_1_node_54 | 672 |
| M78076_PEA_1_node_1 | 673 |
| M78076_PEA_1_node_2 | 674 |
| M78076_PEA_1_node_3 | 675 |
| M78076_PEA_1_node_6 | 676 |
| M78076_PEA_1_node_7 | 677 |
| M78076_PEA_1_node_12 | 678 |
| M78076_PEA_1_node_22 | 679 |
| M78076_PEA_1_node_27 | 680 |
| M78076_PEA_1_node_30 | 681 |

TABLE 687-continued

Segments of interest

| Segment Name | Sequence ID No. |
|---|---|
| M78076_PEA_1_node_31 | 682 |
| M78076_PEA_1_node_34 | 683 |
| M78076_PEA_1_node_36 | 684 |
| M78076_PEA_1_node_41 | 685 |
| M78076_PEA_1_node_42 | 686 |
| M78076_PEA_1_node_43 | 687 |
| M78076_PEA_1_node_45 | 688 |
| M78076_PEA_1_node_49 | 689 |
| M78076_PEA_1_node_50 | 690 |
| M78076_PEA_1_node_51 | 691 |
| M78076_PEA_1_node_52 | 692 |
| M78076_PEA_1_node_53 | 693 |

TABLE 688

Proteins of interest

| Protein Name | Sequence ID No. | Corresponding Transcript(s) |
|---|---|---|
| M78076_PEA_1_P3 | 1350 | M78076_PEA_1_T2 (SEQ ID NO: 74); M78076_PEA_1_T5 (SEQ ID NO: 76) |
| M78076_PEA_1_P4 | 1351 | M78076_PEA_1_T3 (SEQ ID NO: 75) |
| M78076_PEA_1_P12 | 1352 | M78076_PEA_1_T13 (SEQ ID NO: 77) |
| M78076_PEA_1_P14 | 1353 | M78076_PEA_1_T15 (SEQ ID NO: 78) |
| M78076_PEA_1_P21 | 1354 | M78076_PEA_1_T23 (SEQ ID NO: 79) |
| M78076_PEA_1_P24 | 1355 | M78076_PEA_1_T26 (SEQ ID NO: 80) |
| M78076_PEA_1_P2 | 1356 | M78076_PEA_1_T27 (SEQ ID NO: 81) |
| M78076_PEA_1_P25 | 1357 | M78076_PEA_1_T28 (SEQ ID NO: 82) |

These sequences are variants of the known protein Amyloid-like protein 1 precursor (SwissProt accession identifier APP1_HUMAN; known also according to the synonyms APLP; APLP-1), SEQ ID NO: 1439, referred to herein as the previously known protein.

Protein Amyloid-like protein 1 precursor (SEQ ID NO:1439) is known or believed to have the following function(s): May play a role in postsynaptic function. The C-terminal gamma-secretase processed fragment, ALID1, activates transcription activation through APBB1 (Fe65) binding (By similarity). Couples to JIP signal transduction through C-terminal binding. May interact with cellular G-protein signaling pathways. Can regulate neurite outgrowth through binding to components of the extracellular matrix such as heparin and collagen I. The gamma-CTF peptide, C30, is a potent enhancer of neuronal apoptosis (By similarity). The sequence for protein Amyloid-like protein 1 precursor is given at the end of the application, as "Amyloid-like protein 1 precursor amino acid sequence". Known polymorphisms for this sequence are as shown in Table 689.

TABLE 689

Amino acid mutations for Known Protein

| SNP position(s) on amino acid sequence | Comment |
|---|---|
| 48 | A -> P |

Protein Amyloid-like protein 1 precursor (SEQ ID NO:1439) localization is believed to be Type I membrane protein. C-terminally processed in the Golgi complex.

The following GO Annotation(s) apply to the previously known protein. The following annotation(s) were found: endocytosis; apoptosis; cell adhesion; neurogenesis; cell death, which are annotation(s) related to Biological Process; protein binding; heparin binding, which are annotation(s) related to Molecular Function; and basement membrane; coated pit; integral membrane protein, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

As noted above, cluster M78076 features 9 transcript(s), which were listed in Table 1 above. These transcript(s) encode for protein(s) which are variant(s) of protein Amyloid-like protein 1 precursor (SEQ ID NO:1439). A description of each variant protein according to the present invention is now provided.

Variant protein M78076_PEA_1_P3 (SEQ ID NO:1350) according to the present invention has an amino acid sequence as given at the end of the application; it is encoded by transcript(s) M78076_PEA_1_T2 (SEQ ID NO:74). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P3 (SEQ ID NO:1350) and APP1_HUMAN (SEQ ID NO:1439):

1. An isolated chimeric polypeptide encoding for M78076_PEA_1_P3 (SEQ ID NO:1350) comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIYFGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKD corresponding to amino acids 1-517 of APP1_HUMAN (SEQ ID NO:1439), which also corresponds to amino acids 1-517 of M78076_PEA_1_P3 (SEQ ID NO:1350), and a second amino acid sequence being at least 70%, optionally at least 80%, preferably at least 85%, more preferably at least 90% and most preferably at least 95% homologous to a polypeptide having the sequence GE corresponding to amino acids 518-519 of M78076_PEA_1_P3 (SEQ ID NO:1350), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P3 (SEQ ID NO:1350) also has the following non-silent SNPs (Single Nucleotide Polymorphisms) as listed in Table 690, (given according to their position(s) on the amino acid sequence, with the alternative amino acid(s) listed; the last column indicates whether the SNP is known or not; the presence of known SNPs in variant protein M78076_PEA_1_P3 (SEQ ID NO:1350) sequence provides support for the deduced sequence of this variant protein according to the present invention).

TABLE 690

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P3 (SEQ ID NO:1350), as compared to the known protein Amyloid-like protein 1 precursor (SEQ ID NO:1439), are described in Table 691 (given according to their position(s) on the amino acid sequence in the first column; the second column indicates whether the glycosylation site is present in the variant protein; and the last column indicates whether the position is different on the variant protein).

TABLE 691

Glycosylation site(s)

| Position(s) on known amino acid sequence | Present in variant protein | Position in variant protein |
|---|---|---|
| 337 | yes | 337 |
| 461 | yes | 461 |
| 551 | no | |

Variant protein M78076_PEA_1_P3 (SEQ ID NO: 1350) is encoded by the following transcript(s): M78076_PEA_1_T2 (SEQ ID NO:74), for which the sequence(s) is/are given at the end of the application. The coding portion of transcript M78076_PEA_1_T2 (SEQ ID NO:74) is shown in bold; this coding portion starts at position 142 and ends at position 1698. The transcript also has the following SNPs as listed in Table 692 (given according to their position on the nucleotide sequence, with the alternative nucleic acid listed; the last column indicates whether the SNP is known or not; the presence of known SNPs in variant protein M78076_PEA_1_P3 (SEQ ID NO:1350) sequence provides support for the deduced sequence of this variant protein according to the present invention).

TABLE 692

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 2146 | G -> A | Yes |
| 2224 | C -> T | No |
| 2362 | C -> T | Yes |
| 2513 | A -> G | No |
| 2656 | C -> T | Yes |

Variant protein M78076_PEA_1_P4 (SEQ ID NO:1351) according to the present invention has an amino acid sequence as given at the end of the application; it is encoded by transcript(s) M78076_PEA_1_T3 (SEQ ID NO:75). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P4 (SEQ ID NO:1351) and APP1_HUMAN (SEQ ID NO:1439):

1. An isolated chimeric polypeptide encoding for M78076_PEA_1_P4 (SEQ ID NO:1351), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-
CLPGEFVSEALLVPEGCRFLHQERMDQCESSTRRHQ EAQEACSSQGLILHGSGMLLPCGS-
DRFRGVEYVCCPPPGTPDPSGTAVGDPSTRSWPPG SRVEGAEDEEEEESFPQPVDDYFVEP-
PQAEEEEETVPPPSSHTLAVVGKVTPTPRPTDGV DIY-FGMPGEISEHEGFLRAKMDLEERRMR-
QINEVMREWAMADNQSKNLPKADRQALN EHFQSILQTLEEQVSGERQRLVETHA-
TRVIALINDQRRAALEGFLAALQADPPQAERVLL ALRRYLRAEQKEQRHTLRHYQHVAAVD-
PEKAQQMRFQVHTHLQVIEERVNQSLGLLD QNPHLAQELRPQIQELLHSEHLGPSE-
LEAPAPGGSSEDKGGLQPPDSKDDTPMTLPKG corresponding to amino acids 1-526 of APP1_HUMAN (SEQ ID NO:1439), which also corresponds to amino acids 1-526 of M78076_PEA_1_P4 (SEQ ID NO:1351), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:1718) corresponding to amino acids 527-541 of M78076_PEA_1_P4 (SEQ ID NO:1351), wherein said first amino acid sequence and second amino acid sequence are contiguous and in a sequential order.

2. An isolated polypeptide encoding for a tail of M78076_PEA_1_P4 (SEQ ID NO:1351), comprising a polypeptide being at least 70%, optionally at least about 80%, preferably at least about 85%, more preferably at least about 90% and most preferably at least about 95% homologous to the sequence ECLTVNPSLQIPLNP (SEQ ID NO:1718) in M78076_PEA_1_P4 (SEQ ID NO:1351).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P4 (SEQ ID NO:1351) also has the following non-silent SNPs (Single Nucleotide Polymorphisms) as listed in Table 693, (given according to their position(s) on the amino acid sequence, with the alternative amino acid(s) listed; the last column indicates whether the SNP is known or not; the presence of known SNPs in variant protein M78076_PEA_1_P4 (SEQ ID NO:1351) sequence provides support for the deduced sequence of this variant protein according to the present invention).

TABLE 693

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |

TABLE 693-continued

Amino acid mutations

| SNP position(s) on amino acid sequence | Alternative amino acid(s) | Previously known SNP? |
|---|---|---|
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P4 (SEQ ID NO:1351), as compared to the known protein Amyloid-like protein 1 precursor (SEQ ID NO:1439), are described in Table 694 (given according to their position(s) on the amino acid sequence in the first column; the second column indicates whether the glycosylation site is present in the variant protein; and the last column indicates whether the position is different on the variant protein).

TABLE 694

Glycosylation site(s)

| Position(s) on known amino acid sequence | Present in variant protein? | Position in variant protein? |
|---|---|---|
| 337 | yes | 337 |
| 461 | yes | 461 |
| 551 | no | |

Variant protein M78076_PEA_1_P4 (SEQ ID NO:1351) is encoded by the following transcript(s): M78076_PEA_1_T3 (SEQ ID NO:75), for which the sequence(s) is/are given at the end of the application. The coding portion of transcript M78076_PEA_1_T3 (SEQ ID NO:75) is shown in bold; this coding portion starts at position 142 and ends at position 1764. The transcript also has the following SNPs as listed in Table 695 (given according to their position on the nucleotide sequence, with the alternative nucleic acid listed; the last column indicates whether the SNP is known or not; the presence of known SNPs in variant protein M78076_PEA_1_P4 (SEQ ID NO:1351) sequence provides support for the deduced sequence of this variant protein according to the present invention).

TABLE 695

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |

TABLE 695-continued

Nucleic acid SNPs

| SNP position on nucleotide sequence | Alternative nucleic acid | Previously known SNP? |
|---|---|---|
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 1817 | G -> A | Yes |
| 2362 | G -> A | Yes |
| 2440 | C -> T | No |
| 2578 | C -> T | Yes |
| 2729 | A -> G | No |
| 2872 | C -> T | Yes |

Variant protein M78076_PEA_1_P12 (SEQ ID NO:1352) according to the present invention has an amino acid sequence as given at the end of the application; it is encoded by transcript(s) M78076_PEA_1_T13 (SEQ ID NO:77). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P12 (SEQ ID NO:1352) and APP1_HUMAN (SEQ ID NO:1439):

1. An isolated chimeric polypeptide encoding for M78076_PEA_1_P12 (SEQ ID NO:1352), comprising a first amino acid sequence being at least 90% homologous to MGPASPAARGLSRRPGQPPLPLLL-PLLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQIQELLHSEHLGPSE-LEAPAPGGSSEDKGGLQPPDSKDDTPMTLPKG corresponding to amino acids 1-526 of APP_HUMAN (SEQ ID NO:1439), which also corresponds to amino acids 1-526 of M78076_PEA_1_P12 (SEQ ID NO:1352), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO:1719) corresponding to amino acids 527-544 of M78076_PEA_1_P12 (SEQ ID NO:1352), wherein said first amino acid sequence and second amino acid sequence are contiguous and in a sequential order.

2. An isolated polypeptide encoding for a tail of M78076_PEA_1_P12 (SEQ ID NO:1352), comprising a polypeptide being at least 70%, optionally at least about 80%, preferably at least about 85%, more preferably at least about 90% and most preferably at least about 95% homologous to the sequence ECVCSKGFPFPLIGDSEG (SEQ ID NO:1719) in M78076_PEA_1_P12 (SEQ ID NO:1352).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P12 (SEQ ID NO:1352) also has the following non-silent SNPs (Single Nucleotide Polymorphisms) as listed in Table 696, (given according to their position(s) on the amino acid sequence, with the alternative amino acid(s) listed; the last column indicates whether the SNP is known or not; the presence of known SNPs in variant protein M78076_PEA_1_P12 (SEQ ID NO:1352) sequence provides support for the deduced sequence of this variant protein according to the present invention).

TABLE 696

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P12 (SEQ ID NO:1352), as compared to the known protein Amyloid-like protein 1 precursor (SEQ ID NO:1439), are described in Table 697 (given according to their position(s) on the amino acid sequence in the first column; the second column indicates whether the glycosylation site is present in the variant protein; and the last column indicates whether the position is different on the variant protein).

TABLE 697

Glycosylation site(s)

| Position(s) on known amino acid sequence | Present in variant protein? | Position in variant protein? |
|---|---|---|
| 337 | yes | 337 |
| 461 | yes | 461 |
| 551 | no | |

Variant protein M78076_PEA_1_P12 (SEQ ID NO:1352) is encoded by the following transcript(s): M78076_PEA_1_T13 (SEQ ID NO:77), for which the sequence(s) is/are given at the end of the application. The coding portion of transcript M78076_PEA_1_T13 (SEQ ID NO:7) is shown in bold; this coding portion starts at position 142 and ends at position 1773. The transcript also has the following SNPs as listed in Table 698 (given according to their position on the nucleotide sequence, with the alternative nucleic acid listed; the last column indicates whether the SNP is known or not; the presence of known SNPs in variant protein M78076_PEA_1_P12 (SEQ ID NO:1352) sequence provides support for the deduced sequence of this variant protein according to the present invention).

TABLE 698

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 1816 | G -> A | Yes |
| 1894 | C -> T | No |
| 2032 | C -> T | Yes |
| 2183 | A -> G | No |
| 2326 | C -> T | Yes |

Variant protein M78076_PEA_1_P14 (SEQ ID NO:1353) according to the present invention has an amino acid sequence as given at the end of the application; it is encoded by transcript(s) M78076_PEA_1_T15 (SEQ ID NO:78). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P14 (SEQ ID NO:1353) and APP1_HUMAN (SEQ ID NO:1439):

1. An isolated chimeric polypeptide encoding for M78076_PEA_1_P14 (SEQ ID NO:1353), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-
DRFRGVEYVCCPPPGTPDPSGTAVGDPSTRSWPPG
SRVEGAEDEEEEESFPQPVDDYFVEP-
PQAEEEEETVPPPSSHTLAVVGKVTPTPRPTDGV DIY-
FGMPGEISEHEGFLRAKMDLEERRMR-
QINEVMREWAMADNQSKNLPKADRQALN
EHFQSILQTLEEQVSGERQRLVETHA-
TRVIALINDQRRAALEGFLAALQADPPQAERVLL
ALRRYLRAEQKEQRHTLRHYQHVAAVD-
PEKAQQMRFQVHTHLQVIEERVNQSLGLLD
QNPHLAQELRPQIQELLHSEHLGPSE-
LEAPAPGGSSEDKGGLQPPDSKDDTPMTLPKGST
EQDAASPEKEKMNPLEQYERKVNAS-
VPRGFPFHSSEIQRDEL corresponding to amino acids 1-570 of APP1_HUMAN (SEQ ID NO:1439), which also corresponds to amino acids 1-570 of M78076_PEA__1_P14 (SEQ ID NO:1353), and a second amino acid sequence being at least 70%, optionally at least 80%, preferably at least 85%, more preferably at least 90% and most preferably at least 95% homologous to a polypeptide having the sequence VRGG-TAGYLGEETRGQRPGCDSQSHTGPSKKP-SAPSPLPAGTSWDRGVP (SEQ ID NO: 1720) corresponding to amino acids 571-619 of M78076_PEA__1_P14 (SEQ ID NO:1353), wherein said first amino acid sequence and second amino acid sequence are contiguous and in a sequential order.

2. An isolated polypeptide encoding for a tail of M78076_PEA__1_P14 (SEQ ID NO:1353), comprising a polypeptide being at least 70%, optionally at least about 80%, preferably at least about 85%, more preferably at least about 90% and most preferably at least about 95% homologous to the sequence VRGGTAGYLGEETRGQRPGCDSQSHT-GPSKKPSAPSPLPAGTSWDRGVP (SEQ ID NO: 1720) in M78076_PEA__1_P14 (SEQ ID NO:1353).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA__1_P14 (SEQ ID NO:1353) also has the following non-silent SNPs (Single Nucleotide Polymorphisms) as listed in Table 699, (given according to their position(s) on the amino acid sequence, with the alternative amino acid(s) listed; the last column indicates whether the SNP is known or not; the presence of known SNPs in variant protein M78076_PEA__1_P14 (SEQ ID NO:1353) sequence provides support for the deduced sequence of this variant protein according to the present invention).

TABLE 699

Amino acid mutations

| SNP position(s) on amino acid sequence | Alternative amino acid | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |

TABLE 699-continued

Amino acid mutations

| SNP position(s) on amino acid sequence | Alternative amino acid | Previously known SNP? |
|---|---|---|
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA__1_P14 (SEQ ID NO:1353), as compared to the known protein Amyloid-like protein 1 precursor (SEQ ID NO:1439), are described in Table 700 (given according to their position(s) on the amino acid sequence in the first column; the second column indicates whether the glycosylation site is present in the variant protein; and the last column indicates whether the position is different on the variant protein).

TABLE 700

Glycosylation site(s)

| Position(s) on known amino acid sequence | Present in variant protein? | Position in variant protein? |
|---|---|---|
| 337 | yes | 337 |
| 461 | yes | 461 |
| 551 | yes | 551 |

Variant protein M78076_PEA__1_P14 (SEQ ID NO:1353) is encoded by the following transcript(s): M78076_PEA__1_T15 (SEQ ID NO:78), for which the sequence(s) is/are given at the end of the application. The coding portion of transcript M78076_PEA__1_T15 (SEQ ID NO:78) is shown in bold; this coding portion starts at position 142 and ends at position 1998. The transcript also has the following SNPs as listed in Table 701 (given according to their position on the nucleotide sequence, with the alternative nucleic acid listed; the last column indicates whether the SNP is known or not; the presence of known SNPs in variant protein M78076_PEA__1_P14 (SEQ ID NO:1353) sequence provides support for the deduced sequence of this variant protein according to the present invention).

TABLE 701

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |

TABLE 701-continued

Nucleic acid SNPs

| SNP position on nucleotide sequence | Alternative nucleic acid | Previously known SNP? |
|---|---|---|
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 2008 | G -> A | Yes |
| 2086 | C -> T | No |
| 2224 | C -> T | Yes |
| 2375 | A -> G | No |
| 2518 | C -> T | Yes |

Variant protein M78076_PEA_1_P21 (SEQ ID NO:1354) according to the present invention has an amino acid sequence as given at the end of the application; it is encoded by transcript(s) M78076_PEA_1_T23 (SEQ ID NO:79). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P21 (SEQ ID NO:1354) and APP1_HUMAN (SEQ ID NO:1439):

1. An isolated chimeric polypeptide encoding for M78076_PEA_1_P21 (SEQ ID NO:1354), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN E corresponding to amino acids 1-352 of APP1_HUMAN (SEQ ID NO:1439), which also corresponds to amino acids 1-352 of M78076_PEA_1_P21 (SEQ ID NO:1354), and a second amino acid sequence being at least 90% homologous to AERVLLALRRYLRAEQKEQRHTLRHYQH-VAAVDPEKAQQMRFQVHTHLQVIEERVNQ SLGLL-DQNPHLAQELRPQIQELLHSEHLGPSE-LEAPAPGGSSEDKGGLQPPDSKDDTPMT LPKGSTEQDAASPEKEKMNPLEQYERKV-NASVPRGFPFHSSEIQRDELAPAGTGVSREA VSGLLIMGAGGGSLIVLSMLLLR-RKKPYGAISHGVVEVDPMLTLEEQQLRELQRHGYE NPTYRFLEERP corresponding to amino acids 406-650 of APP1_HUMAN (SEQ ID NO:1439), which also corresponds to amino acids 353-597 of M78076_PEA_1_P21 (SEQ ID NO:1354), wherein said first amino acid sequence and second amino acid sequence are contiguous and in a sequential order.

2. An isolated chimeric polypeptide encoding for an edge portion of M78076_PEA_1_P21 (SEQ ID NO:1354), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352−x to 352; and ending at any of amino acid numbers 353+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein M78076_PEA_1_P21 (SEQ ID NO:1354) also has the following non-silent SNPs (Single Nucleotide Polymorphisms) as listed in Table 702, (given according to their position(s) on the amino acid sequence, with the alternative amino acid(s) listed; the last column indicates whether the SNP is known or not; the presence of known SNPs in variant protein M78076_PEA_1_P21 (SEQ ID NO:1354) sequence provides support for the deduced sequence of this variant protein according to the present invention).

TABLE 702

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |

The glycosylation sites of variant protein M78076_PEA_1_P21 (SEQ ID NO:1354), as compared to the known protein Amyloid-like protein 1 precursor (SEQ ID NO:1439), are described in Table 703 (given according to their position(s) on the amino acid sequence in the first column; the second column indicates whether the glycosylation site is present in the variant protein; and the last column indicates whether the position is different on the variant protein).

TABLE 703

Glycosylation site(s)

| Position(s) on known amino acid sequence | Present in variant protein? | Position in variant protien? |
|---|---|---|
| 337 | yes | 337 |
| 461 | yes | 408 |
| 551 | yes | 498 |

Variant protein M78076_PEA_1_P21 (SEQ ID NO:1354) is encoded by the following transcript(s): M78076_PEA_

1_T23 (SEQ ID NO:79), for which the sequence(s) is/are given at the end of the application. The coding portion of transcript M78076_PEA_1_T23 (SEQ ID NO:79) is shown in bold; this coding portion starts at position 142 and ends at position 1932. The transcript also has the following SNPs as listed in Table 704 (given according to their position on the nucleotide sequence, with the alternative nucleic acid listed; the last column indicates whether the SNP is known or not; the presence of known SNPs in variant protein M78076 PEA_1_P21 (SEQ ID NO:1354) sequence provides support for the deduced sequence of this variant protein according to the present invention).

TABLE 704

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1239 | G -> T | Yes |
| 1264 | C -> T | Yes |
| 1728 | G -> A | Yes |
| 1806 | C -> T | No |
| 1944 | C -> T | Yes |
| 2095 | A -> G | No |
| 2238 | C -> T | Yes |

Variant protein M78076_PEA_1_P24 (SEQ ID NO:1355) according to the present invention has an amino acid sequence as given at the end of the application; it is encoded by transcript(s) M78076_PEA_1_T26 (SEQ ID NO:80). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P24 (SEQ ID NO:1355) and APP1_HUMAN (SEQ ID NO:1439):

1. An isolated chimeric polypeptide encoding for M78076_PEA_1_P24 (SEQ ID NO:1355), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIYFGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQVHTHLQVIEERVNQSLGLLD QNPHLAQELRPQI corresponding to amino acids 1-481 of APP1_HUMAN (SEQ ID NO:1439), which also corresponds to amino acids 1-481 of M78076_PEA_1_P24 (SEQ ID NO:1355), and a second amino acid sequence being at least 70%, optionally at least 80%, preferably at least 85%, more preferably at least 90% and most preferably at least 95% homologous to a polypeptide having the sequence RECLLPWLPLQISEGRS (SEQ ID NO: 1721) corresponding to amino acids 482-498 of M78076_PEA_1_P24 (SEQ ID NO:1355), wherein said first amino acid sequence and second amino acid sequence are contiguous and in a sequential order.

2. An isolated polypeptide encoding for a tail of M78076_PEA_1_P24 (SEQ ID NO:1355), comprising a polypeptide being at least 70%, optionally at least about 80%, preferably at least about 85%, more preferably at least about 90% and most preferably at least about 95% homologous to the sequence RECLLPWLPLQISEGRS (SEQ ID NO:1721) in M78076_PEA_1_P24 (SEQ ID NO:1355).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P24 (SEQ ID NO:1355) also has the following non-silent SNPs (Single Nucleotide Polymorphisms) as listed in Table 705, (given according to their position(s) on the amino acid sequence, with the alternative amino acid(s) listed; the last column indicates whether the SNP is known or not; the presence of known SNPs in variant protein M78076_PEA_1_P24 (SEQ ID NO:1355) sequence provides support for the deduced sequence of this variant protein according to the present invention).

TABLE 705

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P24 (SEQ ID NO:1355), as compared to the known protein Amyloid-like protein 1 precursor (SEQ ID NO:1439), are described in Table 706 (given according to their position(s) on the amino acid sequence in the first column; the second column indicates whether the glycosylation site is present in the variant protein; and the last column indicates whether the position is different on the variant protein).

TABLE 706

| | Glycosylation site(s) | |
|---|---|---|
| Position(s) on known amino acid sequence | Present in variant protein? | Position in variant protein? |
| 337 | yes | 337 |
| 461 | yes | 461 |
| 551 | no | |

Variant protein M78076_PEA_1_P24 (SEQ ID NO:1355) is encoded by the following transcript(s): M78076_PEA_1_T26 (SEQ ID NO:80), for which the sequence(s) is/are given at the end of the application. The coding portion of transcript M78076_PEA_1_T26 (SEQ ID NO:80) is shown in bold; this coding portion starts at position 142 and ends at position 1635. The transcript also has the following SNPs as listed in Table 707 (given according to their position on the nucleotide sequence, with the alternative nucleic acid listed; the last column indicates whether the SNP is known or not; the presence of known SNPs in variant protein M78076_PEA_1_P24 (SEQ ID NO:1355) sequence provides support for the deduced sequence of this variant protein according to the present invention).

TABLE 707

| | Nucleic acid SNPs | |
|---|---|---|
| SNP position on nucleotide sequence | Alternative nucleic acid | Previously known SNP? |
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 2184 | G -> A | Yes |

Variant protein M78076_PEA_1_P2 (SEQ ID NO:1356) according to the present invention has an amino acid sequence as given at the end of the application; it is encoded by transcript(s) M78076_PEA_1_T27 (SEQ ID NO:81). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P2 (SEQ ID NO:1356) and APP1_HUMAN (SEQ ID NO:1439):

1. An isolated chimeric polypeptide encoding for M78076_PEA_1_P2 (SEQ ID NO:1356) comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQV corresponding to amino acids 1-449 of APP_HUMAN (SEQ ID NO:1439), which also corresponds to amino acids 1-449 of M78076_PEA_1_P2 (SEQ ID NO:1356), and a second amino acid sequence being at least 70%, optionally at least 80%, preferably at least 85%, more preferably at least 90% and most preferably at least 95% homologous to a polypeptide having the sequence LTSFQLP-NAPLFLRRPRLRLFSCPLDPLS-VSWTPSYPLNTASLPLPSLSAQLPDPETWTLT CCVFD-PCFLALGFLLPPPSILCSVPWIFTAFPRIVFFFFFLRQ VLALSPRQESSVRSWLIAT STSWVQAILLPQPLE (SEQ ID NO:1722) corresponding to amino acids 450-588 of M78076_PEA_1_P2 (SEQ ID NO:1356), wherein said first amino acid sequence and second amino acid sequence are contiguous and in a sequential order.

2. An isolated polypeptide encoding for a tail of M78076_PEA_1_P2 (SEQ ID NO:1356), comprising a polypeptide being at least 70%, optionally at least about 80%, preferably at least about 85%, more preferably at least about 90% and most preferably at least about 95% homologous to the sequence LTSFQLPNAPLFLRRPRLRLFSCPLD-PLSVSWTPSYPLNTASLPLPSLSAQLPDPETWTLT CCVFDPCFLALGFLLPPPSILCSVP-WIFTAFPRIVFFFFFLRQVLALSPRQESSVRSWLIAT STSWVQAILLPQPLE (SEQ ID NO:1722) in M78076_PEA_1_P2 (SEQ ID NO:1356).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein M78076_PEA_1_P2 (SEQ ID NO:1356) also has the following non-silent SNPs (Single Nucleotide Polymorphisms) as listed in Table 708, (given according to their position(s) on the amino acid sequence, with the alternative amino acid(s) listed; the last column indicates whether the SNP is known or not; the presence of known SNPs in variant protein M78076_PEA_1_P2 (SEQ ID NO:1356)

sequence provides support for the deduced sequence of this variant protein according to the present invention).

TABLE 708

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |
| 520 | A -> S | Yes |
| 546 | F -> | Yes |
| 564 | S -> C | Yes |

The glycosylation sites of variant protein M78076_PEA_1_P2 (SEQ ID NO:1356), as compared to the known protein Amyloid-like protein 1 precursor (SEQ ID NO:1439), are described in Table 709 (given according to their position(s) on the amino acid sequence in the first column; the second column indicates whether the glycosylation site is present in the variant protein; and the last column indicates whether the position is different on the variant protein).

TABLE 709

Glycosylation site(s)

| Position(s) on known amino acid sequence | Present in variant protein? | Position in variant protein? |
|---|---|---|
| 337 | yes | 337 |
| 461 | no | |
| 551 | no | |

Variant protein M78076_PEA_1_P2 (SEQ ID NO:1356) is encoded by the following transcript(s): M78076_PEA_1_T27 (SEQ ID NO:81), for which the sequence(s) is/are given at the end of the application. The coding portion of transcript M78076_PEA_1_T27 (SEQ ID NO:81) is shown in bold; this coding portion starts at position 142 and ends at position 1905. The transcript also has the following SNPs as listed in Table 710 (given according to their position on the nucleotide sequence, with the alternative nucleic acid listed; the last column indicates whether the SNP is known or not; the presence of known SNPs in variant protein M78076_PEA_1_P2 (SEQ ID NO:1356) sequence provides support for the deduced sequence of this variant protein according to the present invention).

TABLE 710

Nucleic acid SNPs

| SNP position on nucleotide sequence | Alternative nucleic acid | Previously known SNP? |
|---|---|---|
| 114 | G -> | No |
| 151 | G -> C | Yes |

TABLE 710-continued

Nucleic acid SNPs

| SNP position on nucleotide sequence | Alternative nucleic acid | Previously known SNP? |
|---|---|---|
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 1500 | C -> T | Yes |
| 1699 | G -> T | Yes |
| 1725 | G -> A | Yes |
| 1777 | T -> | Yes |
| 1831 | A -> T | Yes |
| 2274 | A -> G | Yes |
| 2525 | A -> G | Yes |
| 2681 | G -> A | Yes |
| 3831 | G -> A | Yes |

Variant protein M78076_PEA_1_P25 (SEQ ID NO:1357) according to the present invention has an amino acid sequence as given at the end of the application; it is encoded by transcript(s) M78076_PEA_1_T28 (SEQ ID NO:82). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison Report Between M78076_PEA_1_P25 (SEQ ID NO:1357) and APP1_HUMAN (SEQ ID NO:1439):

1. An isolated chimeric polypeptide encoding for M78076_PEA_1_P25 (SEQ ID NO:1357), comprising a first amino acid sequence being at least 90% homologous to MGPASPAARGLSRRPGQPPLPLLL-PLLLLLLRAQPAIGSLAGGSPGAAEAPGSAQVAGL CGRLTLHRDLRTGRWEPDPQRSRRCLRD-PQRVLEYCRQMYPELQIARVEQATQAIPME RWCGGSRSGSCAHPHHQVVPFR-CLPGEFVSEALLVPEGCRFLHQERMDQCESSTRRHQ EAQEACSSQGLILHGSGMLLPCGS-DRFRGVEYVCCPPPGTPDPSGTAVGDPSTRSWPPG SRVEGAEDEEEEESFPQPVDDYFVEP-PQAEEEEETVPPPSSHTLAVVGKVTPTPRPTDGV DIY-FGMPGEISEHEGFLRAKMDLEERRMR-QINEVMREWAMADNQSKNLPKADRQALN EHFQSILQTLEEQVSGERQRLVETHA-TRVIALINDQRRAALEGFLAALQADPPQAERVLL ALRRYLRAEQKEQRHTLRHYQHVAAVD-PEKAQQMRFQ corresponding to amino acids 1-448 of APP1_HUMAN (SEQ ID NO:1439), which also corresponds to amino acids 1-448 of M78076_PEA_1_P25 (SEQ ID NO:1357), and a second amino acid sequence being at least 70%, optionally at least 80%, preferably at least 85%, more preferably at least 90% and most preferably at least 95% homologous to a polypeptide having the sequence PQNPN-SQPRAAGSLEVIISHPFVRRLEIL-ISPFQFQNSIPKNSQIVPAASPRGTSSP (SEQ ID NO:1723) corresponding to amino acids 449-505 of M78076_PEA__1_P25 (SEQ ID NO:1357), wherein said first amino acid sequence and second amino acid sequence are contiguous and in a sequential order.

2. An isolated polypeptide encoding for a tail of M78076_PEA__1_P25 (SEQ ID NO:1357), comprising a polypeptide being at least 70%, optionally at least about 80%, preferably at least about 85%, more preferably at least about 90% and most preferably at least about 95% homologous to the sequence PQNPNSQPRAAGSLEVIISHPFVRRLEI-LISPFQFQNSIPKNSQIVPAASPRGTSSP (SEQ ID NO:1723) in M78076_PEA__1_P25 (SEQ ID NO:1357).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA__1_P25 (SEQ ID NO:1357) also has the following non-silent SNPs (Single Nucleotide Polymorphisms) as listed in Table 711, (given according to their position(s) on the amino acid sequence, with the alternative amino acid(s) listed; the last column indicates whether the SNP is known or not; the presence of known SNPs in variant protein M78076_PEA__1_P25 (SEQ ID NO:1357) sequence provides support for the deduced sequence of this variant protein according to the present invention).

TABLE 711

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA__1_P25 (SEQ ID NO:1357), as compared to the known protein Amyloid-like protein 1 precursor (SEQ ID NO:1439), are described in Table 712 (given according to their position(s) on the amino acid sequence in the first column; the second column indicates whether the glycosylation site is present in the variant protein; and the last column indicates whether the position is different on the variant protein).

TABLE 712

Glycosylation site(s)

| Position(s) on known amino acid sequence | Present in variant protein? | Position in variant protein? |
|---|---|---|
| 337 | yes | 337 |
| 461 | no | |
| 551 | no | |

Variant protein M78076_PEA__1_P25 (SEQ ID NO:1357) is encoded by the following transcript(s): M78076_PEA__1_T28 (SEQ ID NO:82), for which the sequence(s) is/are given at the end of the application. The coding portion of transcript M78076_PEA__1_T28 (SEQ ID NO:82) is shown in bold; this coding portion starts at position 142 and ends at position 1656. The transcript also has the following SNPs as listed in Table 713 (given according to their position on the nucleotide sequence, with the alternative nucleic acid listed; the last column indicates whether the SNP is known or not; the presence of known SNPs in variant protein M78076_PEA__1_P25 (SEQ ID NO:1357) sequence provides support for the deduced sequence of this variant protein according to the present invention).

TABLE 713

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 1593 | A -> G | No |
| 1736 | C -> T | Yes |

As noted above, cluster M78076 features 35 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster M78076_PEA__1_node__0 (SEQ ID NO:659) according to the present invention is supported by 47 libraries. The number of libraries was determined as previously described. This segment can be found in the following transcript(s): M78076_PEA__1_T2 (SEQ ID NO:74), M78076_PEA__1_T3 (SEQ ID NO:75), M78076_PEA__1_T5 (SEQ ID NO:76), M78076_PEA__1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 714 below describes the starting and ending position of this segment on each transcript.

TABLE 714

Segment location on transcripts

| Transcript name | Segment starting position | Segment ending position |
|---|---|---|
| M78076_PEA_1_T2 (SEQ ID NO: 74) | 1 | 160 |
| M78076_PEA_1_T3 (SEQ ID NO: 75) | 1 | 160 |
| M78076_PEA_1_T5 (SEQ ID NO: 76) | 1 | 160 |
| M78076_PEA_1_T13 (SEQ ID NO: 77) | 1 | 160 |
| M78076_PEA_1_T15 (SEQ ID NO: 78) | 1 | 160 |
| M78076_PEA_1_T23 (SEQ ID NO: 79) | 1 | 160 |
| M78076_PEA_1_T26 (SEQ ID NO: 80) | 1 | 160 |
| M78076_PEA_1_T27 (SEQ ID NO: 81) | 1 | 160 |
| M78076_PEA_1_T28 (SEQ ID NO: 82) | 1 | 160 |

Segment cluster M78076_PEA_1_node_10 (SEQ ID NO:660) according to the present invention is supported by 70 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 715 below describes the starting and ending position of this segment on each transcript.

TABLE 715

Segment location on transcripts

| Transcript name | Segment starting position | Segment ending position |
|---|---|---|
| M78076_PEA_1_T2 (SEQ ID NO: 74) | 433 | 565 |
| M78076_PEA_1_T3 (SEQ ID NO: 75) | 433 | 565 |
| M78076_PEA_1_T5 (SEQ ID NO: 76) | 433 | 565 |
| M78076_PEA_1_T13 (SEQ ID NO: 77) | 433 | 565 |
| M78076_PEA_1_T15 (SEQ ID NO: 78) | 433 | 565 |
| M78076_PEA_1_T23 (SEQ ID NO: 79) | 433 | 565 |
| M78076_PEA_1_T26 (SEQ ID NO: 80) | 433 | 565 |
| M78076_PEA_1_T27 (SEQ ID NO: 81) | 433 | 565 |
| M78076_PEA_1_T28 (SEQ ID NO: 82) | 433 | 565 |

Segment cluster M78076_PEA_1_node_15 (SEQ ID NO:661) according to the present invention is supported by 74 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 716 below describes the starting and ending position of this segment on each transcript.

TABLE 716

Segment location on transcripts

| Transcript name | Segment starting position | Segment ending position |
|---|---|---|
| M78076_PEA_1_T2 (SEQ ID NO: 74) | 679 | 812 |
| M78076_PEA_1_T3 (SEQ ID NO: 75) | 679 | 812 |
| M78076_PEA_1_T5 (SEQ ID NO: 76) | 679 | 812 |
| M78076_PEA_1_T13 (SEQ ID NO: 77) | 679 | 812 |
| M78076_PEA_1_T15 (SEQ ID NO: 78) | 679 | 812 |
| M78076_PEA_1_T23 (SEQ ID NO: 79) | 679 | 812 |
| M78076_PEA_1_T26 (SEQ ID NO: 80) | 679 | 812 |
| M78076_PEA_1_T27 (SEQ ID NO: 81) | 679 | 812 |
| M78076_PEA_1_T28 (SEQ ID NO: 82) | 679 | 812 |

Segment cluster M78076_PEA_1_node_18 (SEQ ID NO:662) according to the present invention is supported by 95 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 717 below describes the starting and ending position of this segment on each transcript.

TABLE 717

Segment location on transcripts

| Transcript name | Segment starting position | Segment ending position |
|---|---|---|
| M78076_PEA_1_T2 (SEQ ID NO: 74) | 813 | 991 |
| M78076_PEA_1_T3 (SEQ ID NO: 75) | 813 | 991 |
| M78076_PEA_1_T5 (SEQ ID NO: 76) | 813 | 991 |
| M78076_PEA_1_T13 (SEQ ID NO: 77) | 813 | 991 |
| M78076_PEA_1_T15 (SEQ ID NO: 78) | 813 | 991 |
| M78076_PEA_1_T23 (SEQ ID NO: 79) | 813 | 991 |
| M78076_PEA_1_T26 (SEQ ID NO: 80) | 813 | 991 |
| M78076_PEA_1_T27 (SEQ ID NO: 81) | 813 | 991 |
| M78076_PEA_1_T28 (SEQ ID NO: 82) | 813 | 991 |

Segment cluster M78076_PEA_1_node_20 (SEQ ID NO:663) according to the present invention is supported by 99 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 718 below describes the starting and ending position of this segment on each transcript.

TABLE 718

Segment location on transcripts

| Transcript name | Segment starting position | Segment ending position |
| --- | --- | --- |
| M78076_PEA_1_T2 (SEQ ID NO: 74) | 992 | 1122 |
| M78076_PEA_1_T3 (SEQ ID NO: 75) | 992 | 1122 |
| M78076_PEA_1_T5 (SEQ ID NO: 76) | 992 | 1122 |
| M78076_PEA_1_T13 (SEQ ID NO: 77) | 992 | 1122 |
| M78076_PEA_1_T15 (SEQ ID NO: 78) | 992 | 1122 |
| M78076_PEA_1_T23 (SEQ ID NO: 79) | 992 | 1122 |
| M78076_PEA_1_T26 (SEQ ID NO: 80) | 992 | 1122 |
| M78076_PEA_1_T27 (SEQ ID NO: 81) | 992 | 1122 |
| M78076_PEA_1_T28 (SEQ ID NO: 82) | 992 | 1122 |

Segment cluster M78076_PEA_1_node_24 (SEQ ID NO:664) according to the present invention is supported by 105 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T26 (SEQ ID NO:80), M78076_PEA_1_T27 (SEQ ID NO:81) and M78076_PEA_1_T28 (SEQ ID NO:82). Table 719 below describes the starting and ending position of this segment on each transcript.

TABLE 719

Segment location on transcripts

| Transcript name | Segment starting position | Segment ending position |
| --- | --- | --- |
| M78076_PEA_1_T2 (SEQ ID NO: 74) | 1198 | 1356 |
| M78076_PEA_1_T3 (SEQ ID NO: 75) | 1198 | 1356 |
| M78076_PEA_1_T5 (SEQ ID NO: 76) | 1198 | 1356 |
| M78076_PEA_1_T13 (SEQ ID NO: 77) | 1198 | 1356 |
| M78076_PEA_1_T15 (SEQ ID NO: 78) | 1198 | 1356 |
| M78076_PEA_1_T26 (SEQ ID NO: 80) | 1198 | 1356 |
| M78076_PEA_1_T27 (SEQ ID NO: 81) | 1198 | 1356 |
| M78076_PEA_1_T28 (SEQ ID NO: 82) | 1198 | 1356 |

Segment cluster M78076_PEA_1_node_26 (SEQ ID NO:665) according to the present invention is supported by 99 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 720 below describes the starting and ending position of this segment on each transcript.

TABLE 720

Segment location on transcripts

| Transcript name | Segment starting position | Segment ending position |
| --- | --- | --- |
| M78076_PEA_1_T2 (SEQ ID NO: 74) | 1357 | 1485 |
| M78076_PEA_1_T3 (SEQ ID NO: 75) | 1357 | 1485 |
| M78076_PEA_1_T5 (SEQ ID NO: 76) | 1357 | 1485 |
| M78076_PEA_1_T13 (SEQ ID NO: 77) | 1357 | 1485 |
| M78076_PEA_1_T15 (SEQ ID NO: 78) | 1357 | 1485 |
| M78076_PEA_1_T23 (SEQ ID NO: 79) | 1198 | 1326 |
| M78076_PEA_1_T26 (SEQ ID NO: 80) | 1357 | 1485 |
| M78076_PEA_1_T27 (SEQ ID NO: 81) | 1357 | 1485 |
| M78076_PEA_1_T28 (SEQ ID NO: 82) | 1357 | 1485 |

Segment cluster M78076_PEA_1_node_29 (SEQ ID NO:666) according to the present invention is supported by 2 libraries. The number of libraries was determined as previously described. This segment can be found in the following transcript(s): M78076_PEA_1_T27 (SEQ ID NO:81). Table 721 below describes the starting and ending position of this segment on each transcript.

TABLE 721

Segment location on transcripts

| Transcript name | Segment starting position | Segment ending position |
| --- | --- | --- |
| M78076_PEA_1_T27 (SEQ ID NO: 81) | 1490 | 3132 |

Segment cluster M78076_PEA_1_node_32 (SEQ ID NO:667) according to the present invention is supported by 2 libraries. The number of libraries was determined as previously described. This segment can be found in the following transcript(s): M78076_PEA_1_T26 (SEQ ID NO:80) and M78076_PEA_1_T27 (SEQ ID NO:81). Table 722 below describes the starting and ending position of this segment on each transcript.

TABLE 722

Segment location on transcripts

| Transcript name | Segment starting position | Segment ending position |
| --- | --- | --- |
| M78076_PEA_1_T26 (SEQ ID NO: 80) | 1586 | 2457 |
| M78076_PEA_1_T27 (SEQ ID NO: 81) | 3233 | 4104 |

Segment cluster M78076_PEA_1_node_35 (SEQ ID NO:668) according to the present invention is supported by 4 libraries. The number of libraries was determined as previously described. This segment can be found in the following transcript(s): M78076_PEA_1_T2 (SEQ ID NO:74) and M78076_PEA_1_T5 (SEQ ID NO:76). Table 723 below describes the starting and ending position of this segment on each transcript.

TABLE 723

Segment location on transcripts

| Transcript name | Segment starting position | Segment ending position |
|---|---|---|
| M78076_PEA_1_T2 (SEQ ID NO: 74) | 1694 | 1952 |
| M78076_PEA_1_T5 (SEQ ID NO: 76) | 1694 | 1952 |

Segment cluster M78076_PEA_1_node_37 (SEQ ID NO:669) according to the present invention is supported by 11 libraries. The number of libraries was determined as previously described. This segment can be found in the following transcript(s): M78076_PEA_1_T3 (SEQ ID NO:75) and M78076_PEA_1_T5 (SEQ ID NO:76). Table 724 below describes the starting and ending position of this segment on each transcript.

TABLE 724

Segment location on transcripts

| Transcript name | Segment starting position | Segment ending position |
|---|---|---|
| M78076_PEA_1_T3 (SEQ ID NO: 75) | 1718 | 2180 |
| M78076_PEA_1_T5 (SEQ ID NO: 76) | 1977 | 2439 |

Segment cluster M78076_PEA_1_node_46 (SEQ ID NO:670) according to the present invention is supported by 3 libraries. The number of libraries was determined as previously described. This segment can be found in the following transcript(s): M78076_PEA_1_T15 (SEQ ID NO:78). Table 725 below describes the starting and ending position of this segment on each transcript.

TABLE 725

Segment location on transcripts

| Transcript name | Segment starting position | Segment ending position |
|---|---|---|
| M78076_PEA_1_T15 (SEQ ID NO: 78) | 1852 | 1972 |

Segment cluster M78076_PEA_1_node_47 (SEQ ID NO:671) according to the present invention is supported by 155 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 726 below describes the starting and ending position of this segment on each transcript.

TABLE 726

Segment location on transcripts

| Transcript name | Segment starting position | Segment ending position |
|---|---|---|
| M78076_PEA_1_T2 (SEQ ID NO: 74) | 2111 | 2254 |
| M78076_PEA_1_T3 (SEQ ID NO: 75) | 2327 | 2470 |
| M78076_PEA_1_T5 (SEQ ID NO: 76) | 2586 | 2729 |
| M78076_PEA_1_T13 (SEQ ID NO: 77) | 1781 | 1924 |
| M78076_PEA_1_T15 (SEQ ID NO: 78) | 1973 | 2116 |
| M78076_PEA_1_T23 (SEQ ID NO: 79) | 1693 | 1836 |

Segment cluster M78076_PEA_1_node_54 (SEQ ID NO:672) according to the present invention is supported by 133 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79) and M78076_PEA_1_T28 (SEQ ID NO:82). Table 727 below describes the starting and ending position of this segment on each transcript.

TABLE 727

Segment location on transcripts

| Transcript name | Segment starting position | Segment ending position |
|---|---|---|
| M78076_PEA_1_T2 (SEQ ID NO: 74) | 2412 | 2715 |
| M78076_PEA_1_T3 (SEQ ID NO: 75) | 2628 | 2931 |
| M78076_PEA_1_T5 (SEQ ID NO: 76) | 2887 | 3190 |
| M78076_PEA_1_T13 (SEQ ID NO: 77) | 2082 | 2385 |
| M78076_PEA_1_T15 (SEQ ID NO: 78) | 2274 | 2577 |
| M78076_PEA_1_T23 (SEQ ID NO: 79) | 1994 | 2297 |
| M78076_PEA_1_T28 (SEQ ID NO: 82) | 1492 | 1795 |

According to an optional embodiment of the present invention, short segments related to the above cluster are also provided. These segments are up to about 120 bp in length, and so are included in a separate description.

Segment cluster M78076_PEA_1_node_1 (SEQ ID NO:673) according to the present invention is supported by 47 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 728 below describes the starting and ending position of this segment on each transcript.

TABLE 728

Segment location on transcripts

| Transcript name | Segment starting position | Segment ending position |
|---|---|---|
| M78076_PEA_1_T2 (SEQ ID NO: 74) | 161 | 204 |
| M78076_PEA_1_T3 (SEQ ID NO: 75) | 161 | 204 |
| M78076_PEA_1_T5 (SEQ ID NO: 76) | 161 | 204 |
| M78076_PEA_1_T13 (SEQ ID NO: 77) | 161 | 204 |
| M78076_PEA_1_T15 (SEQ ID NO: 78) | 161 | 204 |
| M78076_PEA_1_T23 (SEQ ID NO: 79) | 161 | 204 |
| M78076_PEA_1_T26 (SEQ ID NO: 80) | 161 | 204 |
| M78076_PEA_1_T27 (SEQ ID NO: 81) | 161 | 204 |
| M78076_PEA_1_T28 (SEQ ID NO: 82) | 161 | 204 |

Segment cluster M78076_PEA_1_node_2 (SEQ ID NO:674) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076 PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 729 below describes the starting and ending position of this segment on each transcript.

TABLE 729

Segment location on transcripts

| Transcript name | Segment starting position | Segment ending position |
|---|---|---|
| M78076_PEA_1_T2 (SEQ ID NO: 74) | 205 | 224 |
| M78076_PEA_1_T3 (SEQ ID NO: 75) | 205 | 224 |
| M78076_PEA_1_T5 (SEQ ID NO: 76) | 205 | 224 |
| M78076_PEA_1_T13 (SEQ ID NO: 77) | 205 | 224 |
| M78076_PEA_1_T15 (SEQ ID NO: 78) | 205 | 224 |
| M78076_PEA_1_T23 (SEQ ID NO: 79) | 205 | 224 |
| M78076_PEA_1_T26 (SEQ ID NO: 80) | 205 | 224 |
| M78076_PEA_1_T27 (SEQ ID NO: 81) | 205 | 224 |
| M78076_PEA_1_T28 (SEQ ID NO: 82) | 205 | 224 |

Segment cluster M78076_PEA_1_node_3 (SEQ ID NO:675) according to the present invention is supported by 52 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 730 below describes the starting and ending position of this segment on each transcript.

TABLE 730

Segment location on transcripts

| Transcript name | Segment starting position | Segment ending position |
|---|---|---|
| M78076_PEA_1_T2 (SEQ ID NO: 74) | 225 | 288 |
| M78076_PEA_1_T3 (SEQ ID NO: 75) | 225 | 288 |
| M78076_PEA_1_T5 (SEQ ID NO: 76) | 225 | 288 |
| M78076_PEA_1_T13 (SEQ ID NO: 77) | 225 | 288 |
| M78076_PEA_1_T15 (SEQ ID NO: 78) | 225 | 288 |
| M78076_PEA_1_T23 (SEQ ID NO: 79) | 225 | 288 |
| M78076_PEA_1_T26 (SEQ ID NO: 80) | 225 | 288 |
| M78076_PEA_1_T27 (SEQ ID NO: 81) | 225 | 288 |
| M78076_PEA_1_T28 (SEQ ID NO: 82) | 225 | 288 |

Segment cluster M78076_PEA_1_node_6 (SEQ ID NO:676) according to the present invention is supported by 59 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 731 below describes the starting and ending position of this segment on each transcript.

TABLE 731

Segment location on transcripts

| Transcript name | Segment starting position | Segment ending position |
|---|---|---|
| M78076_PEA_1_T2 (SEQ ID NO: 74) | 289 | 370 |
| M78076_PEA_1_T3 (SEQ ID NO: 75) | 289 | 370 |
| M78076_PEA_1_T5 (SEQ ID NO: 76) | 289 | 370 |
| M78076_PEA_1_T13 (SEQ ID NO: 77) | 289 | 370 |
| M78076_PEA_1_T15 (SEQ ID NO: 78) | 289 | 370 |
| M78076_PEA_1_T23 (SEQ ID NO: 79) | 289 | 370 |
| M78076_PEA_1_T26 (SEQ ID NO: 80) | 289 | 370 |
| M78076_PEA_1_T27 (SEQ ID NO: 81) | 289 | 370 |
| M78076_PEA_1_T28 (SEQ ID NO: 82) | 289 | 370 |

Segment cluster M78076_PEA_1_node_7 (SEQ ID NO:677) according to the present invention is supported by 64 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 732 below describes the starting and ending position of this segment on each transcript.

TABLE 732

Segment location on transcripts

| Transcript name | Segment starting position | Segment ending position |
|---|---|---|
| M78076_PEA_1_T2 (SEQ ID NO: 74) | 371 | 432 |
| M78076_PEA_1_T3 (SEQ ID NO: 75) | 371 | 432 |
| M78076_PEA_1_T5 (SEQ ID NO: 76) | 371 | 432 |
| M78076_PEA_1_T13 (SEQ ID NO: 77) | 371 | 432 |
| M78076_PEA_1_T15 (SEQ ID NO: 78) | 371 | 432 |
| M78076_PEA_1_T23 (SEQ ID NO: 79) | 371 | 432 |
| M78076_PEA_1_T26 (SEQ ID NO: 80) | 371 | 432 |
| M78076_PEA_1_T27 (SEQ ID NO: 81) | 371 | 432 |
| M78076_PEA_1_T28 (SEQ ID NO: 82) | 371 | 432 |

Segment cluster M78076_PEA_1_node_12 (SEQ ID NO:678) according to the present invention is supported by 71 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 733 below describes the starting and ending position of this segment on each transcript.

TABLE 733

Segment location on transcripts

| Transcript name | Segment starting position | Segment ending position |
|---|---|---|
| M78076_PEA_1_T2 (SEQ ID NO: 74) | 566 | 678 |
| M78076_PEA_1_T3 (SEQ ID NO: 75) | 566 | 678 |
| M78076_PEA_1_T5 (SEQ ID NO: 76) | 566 | 678 |
| M78076_PEA_1_T13 (SEQ ID NO: 77) | 566 | 678 |
| M78076_PEA_1_T15 (SEQ ID NO: 78) | 566 | 678 |
| M78076_PEA_1_T23 (SEQ ID NO: 79) | 566 | 678 |
| M78076_PEA_1_T26 (SEQ ID NO: 80) | 566 | 678 |
| M78076_PEA_1_T27 (SEQ ID NO: 81) | 566 | 678 |
| M78076_PEA_1_T28 (SEQ ID NO: 82) | 566 | 678 |

Segment cluster M78076_PEA_1_node_22 (SEQ ID NO:679) according to the present invention is supported by 92 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 734 below describes the starting and ending position of this segment on each transcript.

TABLE 734

Segment location on transcripts

| Transcript name | Segment starting position | Segment ending position |
|---|---|---|
| M78076_PEA_1_T2 (SEQ ID NO: 74) | 1123 | 1197 |
| M78076_PEA_1_T3 (SEQ ID NO: 75) | 1123 | 1197 |
| M78076_PEA_1_T5 (SEQ ID NO: 76) | 1123 | 1197 |
| M78076_PEA_1_T13 (SEQ ID NO: 77) | 1123 | 1197 |
| M78076_PEA_1_T15 (SEQ ID NO: 78) | 1123 | 1197 |
| M78076_PEA_1_T23 (SEQ ID NO: 79) | 1123 | 1197 |
| M78076_PEA_1_T26 (SEQ ID NO: 80) | 1123 | 1197 |
| M78076_PEA_1_T27 (SEQ ID NO: 81) | 1123 | 1197 |
| M78076_PEA_1_T28 (SEQ ID NO: 82) | 1123 | 1197 |

Segment cluster M78076_PEA_1_node_27 (SEQ ID NO:680) according to the present invention can be found in the following transcript(s): M78076_PEA_1_T27 (SEQ ID NO:81). Table 735 below describes the starting and ending position of this segment on each transcript.

TABLE 735

Segment location on transcripts

| Transcript name | Segment starting position | Segment ending position |
|---|---|---|
| M78076_PEA_1_T27 (SEQ ID NO: 81) | 1486 | 1489 |

Segment cluster M78076_PEA_1_node_30 (SEQ ID NO:681) according to the present invention is supported by 90 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80) and M78076_PEA_1_T27 (SEQ ID NO:81). Table 736 below describes the starting and ending position of this segment on each transcript.

TABLE 736

Segment location on transcripts

| Transcript name | Segment starting position | Segment ending position |
|---|---|---|
| M78076_PEA_1_T2 (SEQ ID NO: 74) | 1486 | 1557 |
| M78076_PEA_1_T3 (SEQ ID NO: 75) | 1486 | 1557 |
| M78076_PEA_1_T5 (SEQ ID NO: 76) | 1486 | 1557 |
| M78076_PEA_1_T13 (SEQ ID NO: 77) | 1486 | 1557 |
| M78076_PEA_1_T15 (SEQ ID NO: 78) | 1486 | 1557 |

TABLE 736-continued

Segment location on transcripts

| Transcript name | Segment starting position | Segment ending position |
|---|---|---|
| M78076_PEA_1_T23 (SEQ ID NO: 79) | 1327 | 1398 |
| M78076_PEA_1_T26 (SEQ ID NO: 80) | 1486 | 1557 |
| M78076_PEA_1_T27 (SEQ ID NO: 81) | 3133 | 3204 |

Segment cluster M78076_PEA_1_node_31 (SEQ ID NO:682) according to the present invention is supported by 89 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80) and M78076_PEA_1_T27 (SEQ ID NO:81). Table 737 below describes the starting and ending position of this segment on each transcript.

TABLE 737

Segment location on transcripts

| Transcript name | Segment starting position | Segment ending position |
|---|---|---|
| M78076_PEA_1_T2 (SEQ ID NO: 74) | 1558 | 1585 |
| M78076_PEA_1_T3 (SEQ ID NO: 75) | 1558 | 1585 |
| M78076_PEA_1_T5 (SEQ ID NO: 76) | 1558 | 1585 |
| M78076_PEA_1_T13 (SEQ ID NO: 77) | 1558 | 1585 |
| M78076_PEA_1_T15 (SEQ ID NO: 78) | 1558 | 1585 |
| M78076_PEA_1_T23 (SEQ ID NO: 79) | 1399 | 1426 |
| M78076_PEA_1_T26 (SEQ ID NO: 80) | 1558 | 1585 |
| M78076_PEA_1_T27 (SEQ ID NO: 81) | 3205 | 3232 |

Segment cluster M78076_PEA_1_node_34 (SEQ ID NO:683) according to the present invention is supported by 103 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 738 below describes the starting and ending position of this segment on each transcript.

TABLE 738

Segment location on transcripts

| Transcript name | Segment starting position | Segment ending position |
|---|---|---|
| M78076_PEA_1_T2 (SEQ ID NO: 74) | 1586 | 1693 |
| M78076_PEA_1_T3 (SEQ ID NO: 75) | 1586 | 1693 |
| M78076_PEA_1_T5 (SEQ ID NO: 76) | 1586 | 1693 |

TABLE 738-continued

Segment location on transcripts

| Transcript name | Segment starting position | Segment ending position |
|---|---|---|
| M78076_PEA_1_T13 (SEQ ID NO: 77) | 1586 | 1693 |
| M78076_PEA_1_T15 (SEQ ID NO: 78) | 1586 | 1693 |
| M78076_PEA_1_T23 (SEQ ID NO: 79) | 1427 | 1534 |

Segment cluster M78076_PEA_1_node_36 (SEQ ID NO:684) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 739 below describes the starting and ending position of this segment on each transcript.

TABLE 739

Segment location on transcripts

| Transcript name | Segment starting position | Segment ending position |
|---|---|---|
| M78076_PEA_1_T2 (SEQ ID NO: 74) | 1953 | 1976 |
| M78076_PEA_1_T3 (SEQ ID NO: 75) | 1694 | 1717 |
| M78076_PEA_1_T5 (SEQ ID NO: 76) | 1953 | 1976 |
| M78076_PEA_1_T13 (SEQ ID NO: 77) | 1694 | 1717 |
| M78076_PEA_1_T15 (SEQ ID NO: 78) | 1694 | 1717 |
| M78076_PEA_1_T23 (SEQ ID NO: 79) | 1535 | 1558 |

Segment cluster M78076_PEA_1_node_41 (SEQ ID NO:685) according to the present invention can be found in the following transcript(s): M78076_PEA_1_T3 (SEQ ID NO:75) and M78076_PEA_1_T5 (SEQ ID NO:76). Table 740 below describes the starting and ending position of this segment on each transcript.

TABLE 740

Segment location on transcripts

| Transcript name | Segment starting position | Segment ending position |
|---|---|---|
| M78076_PEA_1_T3 (SEQ ID NO: 75) | 2181 | 2192 |
| M78076_PEA_1_T5 (SEQ ID NO: 76) | 2440 | 2451 |

Segment cluster M78076_PEA_1_node_42 (SEQ ID NO:686) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T15 (SEQ ID NO:78) and M78076_PEA_1_T23 (SEQ ID NO:79). Table 741 below describes the starting and ending position of this segment on each transcript.

TABLE 741

Segment location on transcripts

| Transcript name | Segment starting position | Segment ending position |
|---|---|---|
| M78076_PEA_1_T2 (SEQ ID NO: 74) | 1977 | 1985 |
| M78076_PEA_1_T3 (SEQ ID NO: 75) | 2193 | 2201 |
| M78076_PEA_1_T5 (SEQ ID NO: 76) | 2452 | 2460 |
| M78076_PEA_1_T15 (SEQ ID NO: 78) | 1718 | 1726 |
| M78076_PEA_1_T23 (SEQ ID NO: 79) | 1559 | 1567 |

Segment cluster M78076_PEA_1_node_43 (SEQ ID NO:687) according to the present invention is supported by 110 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T15 (SEQ ID NO:78) and M78076_PEA_1_T23 (SEQ ID NO:79). Table 742 below describes the starting and ending position of this segment on each transcript.

TABLE 742

Segment location on transcripts

| Transcript name | Segment starting position | Segment ending position |
|---|---|---|
| M78076_PEA_1_T2 (SEQ ID NO: 74) | 1986 | 2047 |
| M78076_PEA_1_T3 (SEQ ID NO: 75) | 2202 | 2263 |
| M78076_PEA_1_T5 (SEQ ID NO: 76) | 2461 | 2522 |
| M78076_PEA_1_T15 (SEQ ID NO: 78) | 1727 | 1788 |
| M78076_PEA_1_T23 (SEQ ID NO: 79) | 1568 | 1629 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 743.

TABLE 743

Oligonucleotides related to this segment

| Oligonucleotide name | Overexpressed in cancers | Chip reference |
|---|---|---|
| M78076_0_7_0 | lung malignant tumors | LUN |

Segment cluster M78076_PEA_1_node_45 (SEQ ID NO:688) according to the present invention is supported by 132 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 744 below describes the starting and ending position of this segment on each transcript.

TABLE 744

Segment location on transcripts

| Transcript name | Segment starting position | Segment ending position |
|---|---|---|
| M78076_PEA_1_T2 (SEQ ID NO: 74) | 2048 | 2110 |
| M78076_PEA_1_T3 (SEQ ID NO: 75) | 2264 | 2326 |
| M78076_PEA_1_T5 (SEQ ID NO: 76) | 2523 | 2585 |
| M78076_PEA_1_T13 (SEQ ID NO: 77) | 1718 | 1780 |
| M78076_PEA_1_T15 (SEQ ID NO: 78) | 1789 | 1851 |
| M78076_PEA_1_T23 (SEQ ID NO: 79) | 1630 | 1692 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 745.

TABLE 745

Oligonucleotides related to this segment

| Oligonucleotide name | Overexpressed in cancers | Chip reference |
|---|---|---|
| M78076_0_7_0 | lung malignant tumors | LUN |

Segment cluster M78076_PEA_1_node_49 (SEQ ID NO:689) according to the present invention is supported by 129 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 746 below describes the starting and ending position of this segment on each transcript.

TABLE 746

Segment location on transcripts

| Transcript name | Segment starting position | Segment ending position |
|---|---|---|
| M78076_PEA_1_T2 (SEQ ID NO: 74) | 2255 | 2290 |
| M78076_PEA_1_T3 (SEQ ID NO: 75) | 2471 | 2506 |
| M78076_PEA_1_T5 (SEQ ID NO: 76) | 2730 | 2765 |
| M78076_PEA_1_T13 (SEQ ID NO: 77) | 1925 | 1960 |
| M78076_PEA_1_T15 (SEQ ID NO: 78) | 2117 | 2152 |
| M78076_PEA_1_T23 (SEQ ID NO: 79) | 1837 | 1872 |

Segment cluster M78076_PEA_1_node_50 (SEQ ID NO:690) according to the present invention is supported by 125 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 747 below describes the starting and ending position of this segment on each transcript.

TABLE 747

Segment location on transcripts

| Transcript name | Segment starting position | Segment ending position |
|---|---|---|
| M78076_PEA_1_T2 (SEQ ID NO: 74) | 2291 | 2329 |
| M78076_PEA_1_T3 (SEQ ID NO: 75) | 2507 | 2545 |
| M78076_PEA_1_T5 (SEQ ID NO: 76) | 2766 | 2804 |
| M78076_PEA_1_T13 (SEQ ID NO: 77) | 1961 | 1999 |
| M78076_PEA_1_T15 (SEQ ID NO: 78) | 2153 | 2191 |
| M78076_PEA_1_T23 (SEQ ID NO: 79) | 1873 | 1911 |

Segment cluster M78076_PEA_1_node_51 (SEQ ID NO:691) according to the present invention is supported by 123 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 748 below describes the starting and ending position of this segment on each transcript.

TABLE 748

Segment location on transcripts

| Transcript name | Segment starting position | Segment ending position |
|---|---|---|
| M78076_PEA_1_T2 (SEQ ID NO: 74) | 2330 | 2388 |
| M78076_PEA_1_T3 (SEQ ID NO: 75) | 2546 | 2604 |
| M78076_PEA_1_T5 (SEQ ID NO: 76) | 2805 | 2863 |
| M78076_PEA_1_T13 (SEQ ID NO: 77) | 2000 | 2058 |
| M78076_PEA_1_T15 (SEQ ID NO: 78) | 2192 | 2250 |
| M78076_PEA_1_T23 (SEQ ID NO: 79) | 1912 | 1970 |

Segment cluster M78076_PEA_1_node_52 (SEQ ID NO:692) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 749 below describes the starting and ending position of this segment on each transcript.

TABLE 749

Segment location on transcripts

| Transcript name | Segment starting position | Segment ending position |
|---|---|---|
| M78076_PEA_1_T2 (SEQ ID NO: 74) | 2389 | 2405 |
| M78076_PEA_1_T3 (SEQ ID NO: 75) | 2605 | 2621 |
| M78076_PEA_1_T5 (SEQ ID NO: 76) | 2864 | 2880 |
| M78076_PEA_1_T13 (SEQ ID NO: 77) | 2059 | 2075 |
| M78076_PEA_1_T15 (SEQ ID NO: 78) | 2251 | 2267 |
| M78076_PEA_1_T23 (SEQ ID NO: 79) | 1971 | 1987 |

Segment cluster M78076_PEA_1_node_53 (SEQ ID NO:693) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79) and M78076_PEA_1_T28 (SEQ ID NO:82). Table 750 below describes the starting and ending position of this segment on each transcript.

TABLE 750

Segment location on transcripts

| Transcript name | Segment starting position | Segment ending position |
|---|---|---|
| M78076_PEA_1_T2 (SEQ ID NO: 74) | 2406 | 2411 |
| M78076_PEA_1_T3 (SEQ ID NO: 75) | 2622 | 2627 |
| M78076_PEA_1_T5 (SEQ ID NO: 76) | 2881 | 2886 |
| M78076_PEA_1_T13 (SEQ ID NO: 77) | 2076 | 2081 |
| M78076_PEA_1_T15 (SEQ ID NO: 78) | 2268 | 2273 |
| M78076_PEA_1_T23 (SEQ ID NO: 79) | 1988 | 1993 |
| M78076_PEA_1_T28 (SEQ ID NO: 82) | 1486 | 1491 |

Variant Protein Alignment to the Previously Known Protein:
Sequence name: APP1_HUMAN (SEQ ID NO:1439)
Sequence documentation:
Alignment of: M78076_PEA_1_P3 (SEQ ID NO:1350) x APP1_HUMAN (SEQ ID NO:1439) ..
Alignment segment 1/1:

| | | | |
|---|---|---|---|
| Quality: | 5132.00 | Escore: | 0 |
| Matching length: | 517 | Total length: | 517 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAGPGGQVVPFRCLPGEFVSEAL 150
    ||||||||||||||||||||||||||||||||||||||||||||||||||
101 ELQIARVEQATQAIPMERWCGGSRSGSCAGPGGQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQERRPQIQELLHSEHLGPSELEAPAP 500
    ||||||||||||||||||||||||||||||||||||||||||||||||||
451 THLQVIEERVNQSLGLLDQNPHLAQERRPQIQELLHSEHLGPSELEAPAP 500

501 GGSSEDKGGLQPPDSKD                                 517
    |||||||||||||||||
501 GGSSEDKGGLQPPDSKD                                 517
```

Sequence name: APP1_HUMAN (SEQ ID NO:1439)

Sequence documentation:

Alignment segment 1/1:

| | | | |
|---|---|---|---|
| Quality: | 5223.00 | Escore: | 0 |
| Matching length: | 526 | Total length: | 526 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment of: M78076_PEA_1_P4 (SEQ ID NO:1351) x APP1_HUMAN (SEQ ID NO:1439) ..

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAGPGGQVVPFRCLPGEFVSEAL 150
    ||||||||||||||||||||||||||||||||||||||||||||||||||
101 ELQIARVEQATQAIPMERWCGGSRSGSCAGPGGQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200
```

-continued

```
201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQERRPQIQELLHSEHLGPSELEAPAP 500
    ||||||||||||||||||||||||||||||||||||||||||||||||||
451 THLQVIEERVNQSLGLLDQNPHLAQERRPQIQELLHSEHLGPSELEAPAP 500

501 GGSSEDKGGLQPPDSKDDTPMTLPKG                         526
    ||||||||||||||||||||||||||
501 GGSSEDKGGLQPPDSKDDTPMTLPKG                         526
```

Sequence name: APP1_HUMAN (SEQ ID NO:1439)

Sequence documentation:

Alignment of: M78076_PEA__1_P12 (SEQ ID NO:1352) x APP1_HUMAN (SEQ ID NO:1439) ..

Alignment segment 1/1:

| | | | |
|---|---|---|---|
| Quality: | 5223.00 | Escore: | 0 |
| Matching length: | 526 | Total length: | 526 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400
```

-continued

```
401  ADPPQAERVLLALRRYLRAEQKEQRHTLRHYQHVAAVDPEKAQQMRFQVH  450
     ||||||||||||||||||||||||||||||||||||||||||||||||||
401  ADPPQAERVLLALRRYLRAEQKEQRHTLRHYQHVAAVDPEKAQQMRFQVH  450

451  THLQVIEERVNQSLGLLDQNPHLAQELRPQIQELLHSEHLGPSELEAPAP  500
     ||||||||||||||||||||||||||||||||||||||||||||||||||
451  THLQVIEERVNQSLGLLDQNPHLAQELRPQIQELLHSEHLGPSELEAPAP  500

501  GGSSEDKGGLQPPDSKDDTPMTLPKG                          526
     |||||||||||||||||||||||||
501  GGSSEDKGGLQPPDSKDDTPMTLPKG                          526
```

Sequence name: APP1_HUMAN (SEQ ID NO:1439)

Sequence documentation:

Alignment of: M78076_PEA_1_P14 (SEQ ID NO:1353) x APP1_HUMAN (SEQ ID NO:1439) ..

Alignment segment 1/1:

| | | | |
|---|---|---|---|
| Quality: | 5672.00 | Escore: | 0 |
| Matching length: | 575 | Total length: | 575 |
| Matching Percent Similarity: | 99.48 | Matching Percent Identity: | 99.48 |
| Total Percent Similarity: | 99.48 | Total Percent Identity: | 99.48 |
| Gaps: | 0 | | |

Alignment:

```
  1  MGPASPAARGLSRRPGQPPLPLLLPLLLLLLRAQPAIGSLAGGSPGAAEA   50
     ||||||||||||||||||||||||||||||||||||||||||||||||||
  1  MGPASPAARGLSRRPGQPPLPLLLPLLLLLLRAQPAIGSLAGGSPGAAEA   50

51  PGSAQVAGLCGRLTLHRDLRTGRWEPDPQRSRRCLRDPQRVLEYCRQMYP  100
     ||||||||||||||||||||||||||||||||||||||||||||||||||
 51  PGSAQVAGLCGRLTLHRDLRTGRWEPDPQRSRRCLRDPQRVLEYCRQMYP  100

101  ELQIARVEQATQAIPMERWCGGSRSGSCAHPHHQVVPFRCLPGEFVSEAL  150
     ||||||||||||||||||||||||||||||||||||||||||||||||||
101  ELQIARVEQATQAIPMERWCGGSRSGSCAHPHHQVVPFRCLPGEFVSEAL  150

151  LVPEGCRFLHQERMDQCESSTRRHQEAQEACSSQGLILHGSGMLLPCGSD  200
     ||||||||||||||||||||||||||||||||||||||||||||||||||
151  LVPEGCRFLHQERMDQCESSTRRHQEAQEACSSQGLILHGSGMLLPCGSD  200

201  RFRGVEYVCCPPPGTPDPSGTAVGDPSTRSWPPGSRVEGAEDEEEEESFP  250
     ||||||||||||||||||||||||||||||||||||||||||||||||||
201  RFRGVEYVCCPPPGTPDPSGTAVGDPSTRSWPPGSRVEGAEDEEEEESFP  250

251  QPVDDYFVEPPQAEEEEETVPPPSSHTLAVVGKVTPTPRPTDGVDIYFGM  300
     ||||||||||||||||||||||||||||||||||||||||||||||||||
251  QPVDDYFVEPPQAEEEEETVPPPSSHTLAVVGKVTPTPRPTDGVDIYFGM  300

301  PGEISEHEGFLRAKMDLEERRMRQINEVMREWAMADNQSKNLPKADRQAL  350
     ||||||||||||||||||||||||||||||||||||||||||||||||||
301  PGEISEHEGFLRAKMDLEERRMRQINEVMREWAMADNQSKNLPKADRQAL  350

351  NEHFQSILQTLEEQVSGERQRLVETHATRVIALINDQRRAALEGFLAALQ  400
     ||||||||||||||||||||||||||||||||||||||||||||||||||
351  NEHFQSILQTLEEQVSGERQRLVETHATRVIALINDQRRAALEGFLAALQ  400

401  ADPPQAERVLLALRRYLRAEQKEQRHTLRHYQHVAAVDPEKAQQMRFQVH  450
     ||||||||||||||||||||||||||||||||||||||||||||||||||
401  ADPPQAERVLLALRRYLRAEQKEQRHTLRHYQHVAAVDPEKAQQMRFQVH  450

451  THLQVIEERVNQSLGLLDQNPHLAQELRPQIQELLHSEHLGPSELEAPAP  500
     ||||||||||||||||||||||||||||||||||||||||||||||||||
451  THLQVIEERVNQSLGLLDQNPHLAQELRPQIQELLHSEHLGPSELEAPAP  500

501  GGSSEDKGGLQPPDSKDDTPMTLPKGSTEQDAASPEKEKMNPLEQYERKV  550
     ||||||||||||||||||||||||||||||||||||||||||||||||||
501  GGSSEDKGGLQPPDSKDDTPMTLPKGSTEQDAASPEKEKMNPLEQYERKV  550

551  NASVPRGFPFHSSEIQRDELVRGGT                          575
     |||||||||||||||||||||  ||
551  NASVPRGFPFHSSEIQRDELAPAGT                          575
```

Sequence name: APP1_HUMAN (SEQ ID NO:1439)

Sequence documentation:

Alignment of: M78076_PEA__1_P21 (SEQ ID NO:1354) x
APP1_HUMAN (SEQ ID NO:1439) ..

Alignment segment 1/1:

| | | | |
|---|---|---|---|
| Quality: | 5822.00 | Escore: | 0 |
| Matching length: | 597 | Total length: | 650 |
| Matching Percent Similarity: | 100.00 | Matching Percent Identity: | 100.00 |
| Total Percent Similarity: | 91.85 | Total Percent Identity: | 91.85 |
| Gaps: | 1 | | |

Alignment:

```
  1  MGPASPAARGLSRRPGQPPLPLLLPLLLLLLRAQPAIGSLAGGSPGAAEA   50
     ||||||||||||||||||||||||||||||||||||||||||||||||||
  1  MGPASPAARGLSRRPGQPPLPLLLPLLLLLLRAQPAIGSLAGGSPGAAEA   50

51  PGSAQVAGLCGRLTLHRDLRTGRWEPDPQRSRRCLRDPQRVLEYCRQMYP  100
     ||||||||||||||||||||||||||||||||||||||||||||||||||
 51  PGSAQVAGLCGRLTLHRDLRTGRWEPDPQRSRRCLRDPQRVLEYCRQMYP  100

101  ELQIARVEQATQAIPMERWCGGSRSGSCAHPHHQVVPFRCLPGEFVSEAL  150
     ||||||||||||||||||||||||||||||||||||||||||||||||||
101  ELQIARVEQATQAIPMERWCGGSRSGSCAHPHHQVVPFRCLPGEFVSEAL  150

151  LVPEGCRFLHQERMDQCESSTRRHQEAQEACSSQGLILHGSGMLLPCGSD  200
     ||||||||||||||||||||||||||||||||||||||||||||||||||
151  LVPEGCRFLHQERMDQCESSTRRHQEAQEACSSQGLILHGSGMLLPCGSD  200

201  RFRGVEYVCCPPPGTPDPSGTAVGDPSTRSWPPGSRVEGAEDEEEEESFP  250
     ||||||||||||||||||||||||||||||||||||||||||||||||||
201  RFRGVEYVCCPPPGTPDPSGTAVGDPSTRSWPPGSRVEGAEDEEEEESFP  250

251  QPVDDYFVEPPQAEEEEETVPPPSSHTLAVVGKVTPTPRPTDGVDIYFGM  300
     ||||||||||||||||||||||||||||||||||||||||||||||||||
251  QPVDDYFVEPPQAEEEEETVPPPSSHTLAVVGKVTPTPRPTDGVDIYFGM  300

301  PGEISEHEGFLRAKMDLEERRMRQINEVMREWAMADNQSKNLPKADRQAL  350
     ||||||||||||||||||||||||||||||||||||||||||||||||||
301  PGEISEHEGFLRAKMDLEERRMRQINEVMREWAMADNQSKNLPKADRQAL  350

351  NE................................................  352
     ||
351  NEHFQSILQTLEEQVSGERQRLVETHATRVIALINDQRRAALEGFLAALQ  400

353  .....AERVLLALRRYLRAEQKEQRHTLRHYQHVAAVDPEKAQQMRFQVH  397
          |||||||||||||||||||||||||||||||||||||||||||||
401  ADPPQAERVLLALRRYLRAEQKEQRHTLRHYQHVAAVDPEKAQQMRFQVH  450

398  THLQVIEERVNQSLGLLDQNPHLAQELRPQIQELLHSEHLGPSELEAPAP  447
     ||||||||||||||||||||||||||||||||||||||||||||||||||
451  THLQVIEERVNQSLGLLDQNPHLAQELRPQIQELLHSEHLGPSELEAPAP  500

448  GGSSEDKGGLQPPDSKDDTPMTLPKGSTEQDAASPEKEKMNPLEQYERKV  497
     ||||||||||||||||||||||||||||||||||||||||||||||||||
501  GGSSEDKGGLQPPDSKDDTPMTLPKGSTEQDAASPEKEKMNPLEQYERKV  550

498  NASVPRGFPFHSSEIQRDELAPAGTGVSREAVSGLLIMGAGGGSLIVLSM  547
     ||||||||||||||||||||||||||||||||||||||||||||||||||
551  NASVPRGFPFHSSEIQRDELAPAGTGVSREAVSGLLIMGAGGGSLIVLSM  600

548  LLLRRKKPYGAISHGVVEVDPMLTLEEQQLRELQRHGYENPTYRFLEERP  597
     ||||||||||||||||||||||||||||||||||||||||||||||||||
601  LLLRRKKPYGAISHGVVEVDPMLTLEEQQLRELQRHGYENPTYRFLEERP  650
```

Sequence name: APP1_HUMAN (SEQ ID NO:1439)

Alignment segment 1/1:

Sequence documentation:

| | | | |
|---|---|---|---|
| Quality: | 4791.00 | Escore: | 0 |
| Matching length: | 485 | Total length: | 485 |
| Matching Percent Similarity: | 99.79 | Matching Percent Identity: | 99.59 |
| Total Percent Similarity: | 99.79 | Total Percent Identity: | 99.59 |
| Gaps: | 0 | | |

Alignment of: M78076_PEA_1_P24 (SEQ ID NO:1355) x APP1_HUMAN (SEQ ID NO:1439) ..

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 PGEISEHEGFLRAKMDLEERRMRQINEVMREWAMADNQSKNLPKADRQAL 400

401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQELRPQIRECL               485
    |||||||||||||||||||||||||||||||:| |
451 THLQVIEERVNQSLGLLDQNPHLAQELRPQIQELL               485
```

Sequence name: APP1_HUMAN (SEQ ID NO:1439)

Sequence documentation:

Alignment of: M78076_PEA_1_P2 (SEQ ID NO:1356) x APP1_HUMAN (SEQ ID NO:1439) ..

Alignment segment 1/1:

| | | | |
|---|---|---|---|
| Quality: | 4474.00 | Escore: | 0 |
| Matching length: | 454 | Total length: | 454 |
| Matching Percent Similarity: | 99.56 | Matching Percent Identity: | 99.34 |
| Total Percent Similarity: | 99.56 | Total Percent Identity: | 99.34 |
| Gaps: | 0 | | |

Alignment:

```
  1  MGPASPAARGLSRRPGQPPLPLLLPLLLLLLRAQPAIGSLAGGSPGAAEA   50
     ||||||||||||||||||||||||||||||||||||||||||||||||||
  1  MGPASPAARGLSRRPGQPPLPLLLPLLLLLLRAQPAIGSLAGGSPGAAEA   50

51  PGSAQVAGLCGRLTLHRDLRTGRWEPDPQRSRRCLRDPQRVLEYCRQMYP  100
     ||||||||||||||||||||||||||||||||||||||||||||||||||
 51  PGSAQVAGLCGRLTLHRDLRTGRWEPDPQRSRRCLRDPQRVLEYCRQMYP  100

101  ELQIARVEQATQAIPMERWCGGSRSGSCAHPHHQVVPFRCLPGEFVSEAL  150
     ||||||||||||||||||||||||||||||||||||||||||||||||||
101  ELQIARVEQATQAIPMERWCGGSRSGSCAHPHHQVVPFRCLPGEFVSEAL  150

151  LVPEGCRFLHQERMDQCESSTRRHQEAQEACSSQGLILHGSGMLLPCGSD  200
     ||||||||||||||||||||||||||||||||||||||||||||||||||
151  LVPEGCRFLHQERMDQCESSTRRHQEAQEACSSQGLILHGSGMLLPCGSD  200

201  RFRGVEYVCCPPPGTPDPSGTAVGDPSTRSWPPGSRVEGAEDEEEEESFP  250
     ||||||||||||||||||||||||||||||||||||||||||||||||||
201  RFRGVEYVCCPPPGTPDPSGTAVGDPSTRSWPPGSRVEGAEDEEEEESFP  250

251  QPVDDYFVEPPQAEEEEETVPPPSSHTLAVVGKVTPTPRPTDGVDIYFGM  300
     ||||||||||||||||||||||||||||||||||||||||||||||||||
251  QPVDDYFVEPPQAEEEEETVPPPSSHTLAVVGKVTPTPRPTDGVDIYFGM  300

301  PGEISEHEGFLRAKMDLEERRMRQINEVMREWAMADNQSKNLPKADRQAL  350
     ||||||||||||||||||||||||||||||||||||||||||||||||||
301  PGEISEHEGFLRAKMDLEERRMRQINEVMREWAMADNQSKNLPKADRQAL  350

351  NEHFQSILQTLEEQVSGERQRLVETHATRVIALINDQRRAALEGFLAALQ  400
     ||||||||||||||||||||||||||||||||||||||||||||||||||
351  NEHFQSILQTLEEQVSGERQRLVETHATRVIALINDQRRAALEGFLAALQ  400

401  ADPPQAERVLLALRRYLRAEQKEQRHTLRHYQHVAAVDPEKAQQMRFQVL  450
     ||||||||||||||||||||||||||||||||||||||||||||||||||
401  ADPPQAERVLLALRRYLRAEQKEQRHTLRHYQHVAAVDPEKAQQMRFQVL  450

451  TSFQ  454
     | :|
451  THLQ  454
```

Sequence name: APP1_HUMAN (SEQ ID NO:1439)

Sequence documentation:

Alignment of: M78076_PEA__1_P25 (SEQ ID NO:1357) x APP1_HUMAN (SEQ ID NO:1439) ..

Alignment segment 1/1:

| | | | |
|---|---|---|---|
| Quality: | 4455.00 | Escore: | 0 |
| Matching length: | 448 | Total length: | 448 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MGPASPAARGLSRRPGQPPLPLLLPLLLLLLRAQPAIGSLAGGSPGAAEA   50
     ||||||||||||||||||||||||||||||||||||||||||||||||||
  1  MGPASPAARGLSRRPGQPPLPLLLPLLLLLLRAQPAIGSLAGGSPGAAEA   50

51  PGSAQVAGLCGRLTLHRDLRTGRWEPDPQRSRRCLRDPQRVLEYCRQMYP  100
     ||||||||||||||||||||||||||||||||||||||||||||||||||
 51  PGSAQVAGLCGRLTLHRDLRTGRWEPDPQRSRRCLRDPQRVLEYCRQMYP  100

101  ELQIARVEQATQAIPMERWCGGSRSGSCAHPHHQVVPFRCLPGEFVSEAL  150
     ||||||||||||||||||||||||||||||||||||||||||||||||||
101  ELQIARVEQATQAIPMERWCGGSRSGSCAHPHHQVVPFRCLPGEFVSEAL  150

151  LVPEGCRFLHQERMDQCESSTRRHQEAQEACSSQGLILHGSGMLLPCGSD  200
     ||||||||||||||||||||||||||||||||||||||||||||||||||
151  LVPEGCRFLHQERMDQCESSTRRHQEAQEACSSQGLILHGSGMLLPCGSD  200

201  RFRGVEYVCCPPPGTPDPSGTAVGDPSTRSWPPGSRVEGAEDEEEEESFP  250
     ||||||||||||||||||||||||||||||||||||||||||||||||||
201  RFRGVEYVCCPPPGTPDPSGTAVGDPSTRSWPPGSRVEGAEDEEEEESFP  250

251  QPVDDYFVEPPQAEEEEETVPPPSSHTLAVVGKVTPTPRPTDGVDIYFGM  300
     ||||||||||||||||||||||||||||||||||||||||||||||||||
251  QPVDDYFVEPPQAEEEEETVPPPSSHTLAVVGKVTPTPRPTDGVDIYFGM  300

301  PGEISEHEGFLRAKMDLEERRMRQINEVMREWAMADNQSKNLPKADRQAL  350
     ||||||||||||||||||||||||||||||||||||||||||||||||||
301  PGEISEHEGFLRAKMDLEERRMRQINEVMREWAMADNQSKNLPKADRQAL  350

351  NEHFQSILQTLEEQVSGERQRLVETHATRVIALINDQRRAALEGFLAALQ  400
     ||||||||||||||||||||||||||||||||||||||||||||||||||
351  NEHFQSILQTLEEQVSGERQRLVETHATRVIALINDQRRAALEGFLAALQ  400

401  ADPPQAERVLLALRRYLRAEQKEQRHTLRHYQHVAAVDPEKAQQMRFQ   448
     |||||||||||||||||||||||||||||||||||||||||||||||
401  ADPPQAERVLLALRRYLRAEQKEQRHTLRHYQHVAAVDPEKAQQMRFQ   448
```

Description for Cluster T99080

Cluster T99080 features 14 transcript(s) and 11 segment(s) of interest, the names for which are given in Tables 751 and 752, respectively, the sequences themselves are given at the end of the application. The selected protein variants are given in table 753.

TABLE 751

Transcripts of interest

| Transcript Name | Sequence ID No. |
| --- | --- |
| T99080_PEA_4_T0 | 83 |
| T99080_PEA_4_T2 | 84 |
| T99080_PEA_4_T4 | 85 |
| T99080_PEA_4_T6 | 86 |
| T99080_PEA_4_T9 | 87 |
| T99080_PEA_4_T10 | 88 |
| T99080_PEA_4_T11 | 89 |
| T99080_PEA_4_T13 | 90 |
| T99080_PEA_4_T14 | 91 |
| T99080_PEA_4_T17 | 92 |
| T99080_PEA_4_T18 | 93 |
| T99080_PEA_4_T19 | 94 |
| T99080_PEA_4_T20 | 95 |
| T99080_PEA_4_T21 | 96 |

TABLE 752

Segments of interest

| Segment Name | Sequence ID No. |
| --- | --- |
| T99080_PEA_4_node_1 | 695 |
| T99080_PEA_4_node_6 | 696 |
| T99080_PEA_4_node_11 | 697 |
| T99080_PEA_4_node_19 | 698 |
| T99080_PEA_4_node_20 | 699 |
| T99080_PEA_4_node_3 | 700 |
| T99080_PEA_4_node_5 | 701 |
| T99080_PEA_4_node_8 | 702 |
| T99080_PEA_4_node_13 | 703 |
| T99080_PEA_4_node_15 | 704 |
| T99080_PEA_4_node_18 | 705 |

TABLE 753

Proteins of interest

| Protein Name | Sequence ID No. | Corresponding Transcript(s) |
| --- | --- | --- |
| T99080_PEA_4_P1 | 1358 | T99080_PEA_4_T0 (SEQ ID NO: 83) |
| T99080_PEA_4_P2 | 1359 | T99080_PEA_4_T2 (SEQ ID NO: 84) |
| T99080_PEA_4_P5 | 1360 | T99080_PEA_4_T6 (SEQ ID NO: 86) |
| T99080_PEA_4_P8 | 1361 | T99080_PEA_4_T9 (SEQ ID NO: 87) |
| T99080_PEA_4_P9 | 1362 | T99080_PEA_4_T10 (SEQ ID NO: 88) |
| T99080_PEA_4_P10 | 1363 | T99080_PEA_4_T11 (SEQ ID NO: 89) |
| T99080_PEA_4_P12 | 1364 | T99080_PEA_4_T14 (SEQ ID NO: 91) |
| T99080_PEA_4_P13 | 1365 | T99080_PEA_4_T17 (SEQ ID NO: 92) |
| T99080_PEA_4_P14 | 1366 | T99080_PEA_4_T18 (SEQ ID NO: 93) |
| T99080_PEA_4_P15 | 1367 | T99080_PEA_4_T19 (SEQ ID NO: 94) |
| T99080_PEA_4_P16 | 1368 | T99080_PEA_4_T20 (SEQ ID NO: 95) |
| T99080_PEA_4_P17 | 1369 | T99080_PEA_4_T21 (SEQ ID NO: 96) |

These sequences are variants of the known protein Acylphosphatase, organ-common type isozyme (SwissProt accession identifier ACYO_HUMAN; known also according to the synonyms EC 3.6.1.7; Acylphosphate phosphohydrolase; Acylphosphatase, erythrocyte isozyme), SEQ ID NO: 1440, referred to herein as the previously known protein.

The sequence for protein Acylphosphatase (SEQ ID NO:1440), organ-common type isozyme is given at the end of the application, as "Acylphosphatase, organ-common type isozyme amino acid sequence". Known polymorphisms for this sequence are as shown in Table 754.

TABLE 754

Amino acid mutations for Known Protein

| SNP position(s) on amino acid sequence | Comment |
| --- | --- |
| 19 | G -> R |

The following GO Annotation(s) apply to the previously known protein. The following annotation(s) were found: phosphate metabolism, which are annotation(s) related to Biological Process; and acylphosphatase, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

As noted above, cluster T99080 features 14 transcript(s), which were listed in Table 1 above. These transcript(s) encode for protein(s) which are variant(s) of protein Acylphosphatase (SEQ ID NO:1440), organ-common type isozyme. A description of each variant protein according to the present invention is now provided.

Variant protein T99080_PEA_4_P1 (SEQ ID NO:1358) according to the present invention has an amino acid sequence as given at the end of the application; it is encoded by transcript(s) T99080_PEA_4_T0 (SEQ ID NO:83). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P1 (SEQ ID NO:1358) also has the following non-silent SNPs (Single Nucleotide Polymorphisms) as listed in Table 755, (given according to their position(s) on the amino acid sequence, with the alternative amino acid(s) listed; the last column indicates whether the SNP is known or not; the presence of known SNPs in variant protein T99080_PEA_4_P1 (SEQ ID NO:1358) sequence provides support for the deduced sequence of this variant protein according to the present invention).

TABLE 755

Amino acid mutations

| SNP position(s) on amino acid sequence | Alternative amino acid(s) | Previously known SNP? |
|---|---|---|
| 23 | A -> V | Yes |

Variant protein T99080_PEA_4_P1 (SEQ ID NO:1358) is encoded by the following transcript(s): T99080_PEA_4_T0 (SEQ ID NO:83), for which the sequence(s) is/are given at the end of the application. The coding portion of transcript T99080_PEA_4_T0 (SEQ ID NO:83) is shown in bold; this coding portion starts at position 226 and ends at position 411. The transcript also has the following SNPs as listed in Table 756 (given according to their position on the nucleotide sequence, with the alternative nucleic acid listed; the last column indicates whether the SNP is known or not; the presence of known SNPs in variant protein T99080_PEA_4_P1 (SEQ ID NO:1358) sequence provides support for the deduced sequence of this variant protein according to the present invention).

TABLE 756

Nucleic acid SNPs

| SNP position on nucleotide sequence | Alternative nucleic acid | Previously known SNP? |
|---|---|---|
| 293 | C -> T | Yes |
| 1293 | G -> C | Yes |
| 2034 | A -> G | Yes |
| 2114 | A -> C | Yes |
| 2153 | -> A | No |

Variant protein T99080_PEA_4_P2 (SEQ ID NO:1359) according to the present invention has an amino acid sequence as given at the end of the application; it is encoded by transcript(s) T99080_PEA_4_T2 (SEQ ID NO:84). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P2 (SEQ ID NO:1359) is encoded by the following transcript(s): T99080_PEA_4_T2 (SEQ ID NO:84), for which the sequence(s) is/are given at the end of the application. The coding portion of transcript T99080_PEA_4_T2 (SEQ ID NO:84) is shown in bold; this coding portion starts at position 1 and ends at position 192. The transcript also has the following SNPs as listed in Table 757 (given according to their position on the nucleotide sequence, with the alternative nucleic acid listed; the last column indicates whether the SNP is known or not; the presence of known SNPs in variant protein T99080_PEA_4_P2 (SEQ ID NO:1359) sequence provides support for the deduced sequence of this variant protein according to the present invention).

TABLE 757

Nucleic acid SNPs

| SNP position on nucleotide sequence | Alternative nucleic acid | Previously known SNP? |
|---|---|---|
| 1074 | G -> C | Yes |
| 1815 | A -> G | Yes |
| 1895 | A -> C | Yes |
| 1934 | -> A | No |

Variant protein T99080_PEA_4_P5 (SEQ ID NO:1360) according to the present invention has an amino acid sequence as given at the end of the application; it is encoded by transcript(s) T99080_PEA_4_T6 (SEQ ID NO:86). An alignment is given to the known protein (Acylphosphatase (SEQ ID NO:1440), organ-common type isozyme) at the end of the application. One or more alignments to one or more previously published protein sequences are given at the end of the application. A brief description of the relationship of the variant protein according to the present invention to each such aligned protein is as follows:

Comparison Report Between T99080_PEA_4_P5 (SEQ ID NO:1360) and ACYO_HUMAN_V1 (SEQ ID NO:1441):

1. An isolated chimeric polypeptide encoding for T99080_PEA_4_P5 (SEQ ID NO:1360), comprising a first amino acid sequence being at least 70%, optionally at least 80%, preferably at least 85%, more preferably at least 90% and most preferably at least 95% homologous to a polypeptide having the sequence MPASARLAGAGLLLAFLRALG-CAGRAPGLS (SEQ ID NO: 1732) corresponding to amino acids 1-30 of T99080_PEA_4_P5 (SEQ ID NO:1360), and a second amino acid sequence being at least 90% homologous to MAEGNTLISVDYEIFGKVQGVF-FRKHTQAEGKKLGLVGWVQNTDRGTVQGQLQGPIS KVRHMQEWLETRGSPKSHIDKANFN-NEKVILKLDYSDFQIVK corresponding to amino acids 1-99 of ACYO_HUMAN_V1 (SEQ ID NO:1441), which also corresponds to amino acids 31-129 of T99080_PEA_4_P5 (SEQ ID NO:1360), wherein said first amino acid sequence and second amino acid sequence are contiguous and in a sequential order.

2. An isolated polypeptide encoding for a head of T99080_PEA_4_P5 (SEQ ID NO:1360), comprising a polypeptide being at least 70%, optionally at least about 80%, preferably at least about 85%, more preferably at least about 90% and most preferably at least about 95% homologous to the sequence MPASARLAGAGLLLAFLRALGCA-GRAPGLS (SEQ ID NO: 1732) of T99080_PEA_4_P5 (SEQ ID NO:1360).

It should be noted that the known protein sequence (ACYO_HUMAN (SEQ ID NO:1440)) has one or more changes than the sequence given at the end of the application and named as being the amino acid sequence for ACYO_HUMAN_V1 (SEQ ID NO:1441). These changes were previously known to occur and are listed in the table below.

TABLE 758

Changes to ACYO_HUMAN_V1 (SEQ ID NO: 1441)

| SNP position(s) on amino acid sequence | Type of change |
|---|---|
| 1 | init_met |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P5 (SEQ ID NO:1360) also has the following non-silent SNPs (Single Nucleotide Polymorphisms) as listed in Table 759, (given according to their position(s) on the amino acid sequence, with the alternative amino acid(s) listed; the last column indicates whether the SNP is known or not; the presence of known SNPs in variant protein T99080_PEA_4_P5 (SEQ ID NO:1360) sequence provides support for the deduced sequence of this variant protein according to the present invention).

TABLE 759

Amino acid mutations

| SNP position(s) on amino acid sequence | Alternative amino acid(s) | Previously known SNP? |
| --- | --- | --- |
| 23 | A -> V | Yes |

Variant protein T99080_PEA_4_P5 (SEQ ID NO:1360) is encoded by the following transcript(s): T99080_PEA_4_T6 (SEQ ID NO:86), for which the sequence(s) is/are given at the end of the application. The coding portion of transcript T99080_PEA_4_T6 (SEQ ID NO:86) is shown in bold; this coding portion starts at position 226 and ends at position 612. M78076_PEA_1_P21 (SEQ ID NO:1354) sequence provides support for the deduced sequence position on the nucleotide sequence, with the alternative nucleic acid listed; the last column indicates whether the SNP is known or not; the presence of known SNPs in variant protein T99080_PEA_4_P5 (SEQ ID NO:1360) sequence provides support for the deduced sequence of this variant protein according to the present invention).

TABLE 760

Nucleic acid SNPs

| SNP position on nucleotide sequence | Alternative nucleic acid | Previously known SNP? |
| --- | --- | --- |
| 293 | C -> T | Yes |
| 697 | A -> G | Yes |
| 777 | A -> C | Yes |
| 816 | -> A | No |

Variant protein T99080_PEA_4_P8 (SEQ ID NO:1361) according to the present invention has an amino acid sequence as given at the end of the application; it is encoded by transcript(s) T99080_PEA_4_T9 (SEQ ID NO:87). An alignment is given to the known protein (Acylphosphatase (SEQ ID NO:1440), organ-common type isozyme) at the end of the application. One or more alignments to one or more previously published protein sequences are given at the end of the application. A brief description of the relationship of the variant protein according to the present invention to each such aligned protein is as follows:

Comparison Report Between T99080_PEA_4_P8 (SEQ ID NO:1361) and ACYO_HUMAN_V1 (SEQ ID NO:1441):

1. An isolated chimeric polypeptide encoding for T99080_PEA_4_P8 (SEQ ID NO:1361), comprising a first amino acid sequence being at least 70%, optionally at least 80%, preferably at least 85%, more preferably at least 90% and most preferably at least 95% homologous to a polypeptide having the sequence M corresponding to amino acids 1-1 of T99080_PEA_4_P8 (SEQ ID NO:1361), and a second amino acid sequence being at least 90% homologous to QAEGKKLGLVGWVQNTDRGTVQGQLQG-PISKVRHMQEWLETRGSPKSHIDKANFNNE KVILKLDYSDFQIVK corresponding to amino acids 28-99 of ACYO_HUMAN_V1 (SEQ ID NO:1441), which also corresponds to amino acids 2-73 of T99080_PEA_4_P8 (SEQ ID NO:1361), wherein said first amino acid sequence and second amino acid sequence are contiguous and in a sequential order.

It should be noted that the known protein sequence (ACYO_HUMAN (SEQ ID NO:1440)) has one or more changes than the sequence given at the end of the application and named as being the amino acid sequence for ACYO_HUMAN_V1 (SEQ ID NO:1441). These changes were previously known to occur and are listed in the table below.

TABLE 761

Changes to ACYO_HUMAN_V1 (SEQ ID NO: 1441)

| SNP position(s) on amino acid sequence | Type of change |
| --- | --- |
| 1 | init_met |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T99080_PEA_4_P8 (SEQ ID NO:1361) is encoded by the following transcript(s): T99080_PEA_4_T9 (SEQ ID NO:87), for which the sequence(s) is/are given at the end of the application. The coding portion of transcript T99080_PEA_4_T9 (SEQ ID NO:87) is shown in bold; this coding portion starts at position 162 and ends at position 380. The transcript also has the following SNPs as listed in Table 762 (given according to their position on the nucleotide sequence, with the alternative nucleic acid listed; the last column indicates whether the SNP is known or not; the presence of known SNPs in variant protein T99080_PEA_4_P8 (SEQ ID NO:1361) sequence provides support for the deduced sequence of this variant protein according to the present invention).

TABLE 762

Nucleic acid SNPs

| SNP position on nucleotide sequence | Alternative nucleic acid | Previously known SNP? |
| --- | --- | --- |
| 465 | A -> G | Yes |
| 545 | A -> C | Yes |
| 584 | -> A | No |

Variant protein T99080_PEA_4_P9 (SEQ ID NO:1362) according to the present invention has an amino acid sequence as given at the end of the application; it is encoded by transcript(s) T99080_PEA_4_T10 (SEQ ID NO:88). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P9 (SEQ ID NO:1362) is encoded by the following transcript(s): T99080_PEA_4_T10 (SEQ ID NO:88), for which the sequence(s) is/are given at the end of the application. The coding portion of transcript T99080_PEA_4_T10 (SEQ ID NO:88) is shown in bold; this coding portion starts at position 1 and ends at position 261. The transcript also has the following SNPs as listed in Table 763 (given according to their position on the nucleotide sequence, with the alternative nucleic acid listed; the last column indicates whether the SNP is known or not; the presence of known SNPs in variant protein T99080_PEA_4_P9 (SEQ ID NO:1362) sequence provides support for the deduced sequence of this variant protein according to the present invention).

TABLE 763

| Nucleic acid SNPs | | |
|---|---|---|
| SNP position on nucleotide sequence | Alternative nucleic acid | Previously known SNP? |
| 557 | A -> G | Yes |
| 637 | A -> C | Yes |
| 676 | -> A | No |

Variant protein T99080_PEA_4_P10 (SEQ ID NO:1363) according to the present invention has an amino acid sequence as given at the end of the application; it is encoded by transcript(s) T99080_PEA_4_T11 (SEQ ID NO:89). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P10 (SEQ ID NO:1363) is encoded by the following transcript(s): T99080_PEA_4_T11 (SEQ ID NO:89), for which the sequence(s) is/are given at the end of the application. The coding portion of transcript T99080_PEA_4_T11 (SEQ ID NO:89) is shown in bold; this coding portion starts at position 1 and ends at position 240. The transcript also has the following SNPs as listed in Table 764 (given according to their position on the nucleotide sequence, with the alternative nucleic acid listed; the last column indicates whether the SNP is known or not; the presence of known SNPs in variant protein T99080_PEA_4_P10 (SEQ ID NO:1363) sequence provides support for the deduced sequence of this variant protein according to the present invention).

TABLE 764

| Nucleic acid SNPs | | |
|---|---|---|
| SNP position on nucleotide sequence | Alternative nucleic acid | Previously known SNP? |
| 269 | G -> T | Yes |
| 592 | A -> G | Yes |
| 672 | A -> C | Yes |
| 711 | -> A | No |

Variant protein T99080_PEA_4_P12 (SEQ ID NO:1364) according to the present invention has an amino acid sequence as given at the end of the application; it is encoded by transcript(s) T99080_PEA_4_T14 (SEQ ID NO:91). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P12 (SEQ ID NO:1364) is encoded by the following transcript(s): T99080_PEA_4_T14 (SEQ ID NO:91), for which the sequence(s) is/are given at the end of the application. The coding portion of transcript T99080_PEA_4_T14 (SEQ ID NO:91) is shown in bold; this coding portion starts at position 1 and ends at position 282.

Variant protein T99080_PEA_4_P13 (SEQ ID NO:1365) according to the present invention has an amino acid sequence as given at the end of the application; it is encoded by transcript(s) T99080_PEA_4_T17 (SEQ ID NO:92). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P13 (SEQ ID NO:1365) is encoded by the following transcript(s): T99080_PEA_4_T17 (SEQ ID NO:92), for which the sequence(s) is/are given at the end of the application. The coding portion of transcript T99080_PEA_4_T17 (SEQ ID NO:92) is shown in bold; this coding portion starts at position 1 and ends at position 207.

Variant protein T99080_PEA_4_P14 (SEQ ID NO:1366) according to the present invention has an amino acid sequence as given at the end of the application; it is encoded by transcript(s) T99080_PEA_4_T18 (SEQ ID NO:93). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P14 (SEQ ID NO:1366) also has the following non-silent SNPs (Single Nucleotide Polymorphisms) as listed in Table 765, (given according to their position(s) on the amino acid sequence, with the alternative amino acid(s) listed; the last column indicates whether the SNP is known or not; the presence of known SNPs in variant protein T99080_PEA_4_P14 (SEQ ID NO:1366) sequence provides support for the deduced sequence of this variant protein according to the present invention).

TABLE 765

Amino acid mutations

| SNP position(s) on amino acid sequence | Alternative amino acid(s) | Previously known SNP? |
|---|---|---|
| 23 | A -> V | Yes |

Variant protein T99080_PEA_4_P14 (SEQ ID NO:1366) is encoded by the following transcript(s): T99080_PEA_4_T18 (SEQ ID NO:93), for which the sequence(s) is/are given at the end of the application. The coding portion of transcript T99080_PEA_4_T18 (SEQ ID NO:93) is shown in bold; this coding portion starts at position 226 and ends at position 480. The transcript also has the following SNPs as listed in Table 766 (given according to their position on the nucleotide sequence, with the alternative nucleic acid listed; the last column indicates whether the SNP is known or not; the presence of known SNPs in variant protein T99080_PEA_4_P14 (SEQ ID NO:1366) sequence provides support for the deduced sequence of this variant protein according to the present invention).

TABLE 766

Nucleic acid SNPs

| SNP position on nucleotide sequence | Alternative nucleic acid | Previously known SNP? |
|---|---|---|
| 293 | C -> T | Yes |
| 776 | A -> G | Yes |
| 856 | A -> C | Yes |
| 895 | -> A | No |

Variant protein T99080_PEA_4_P15 (SEQ ID NO:1367) according to the present invention has an amino acid sequence as given at the end of the application; it is encoded by transcript(s) T99080_PEA_4_T19 (SEQ ID NO:94). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P15 (SEQ ID NO:1367) also has the following non-silent SNPs (Single Nucleotide Polymorphisms) as listed in Table 767, (given according to their position(s) on the amino acid sequence, with the alternative amino acid(s) listed; the last column indicates whether the SNP is known or not; the presence of known SNPs in variant protein T99080_PEA_4_P15 (SEQ ID NO:1367) sequence provides support for the deduced sequence of this variant protein according to the present invention).

TABLE 767

Amino acid mutations

| SNP position(s) on amino acid sequence | Alternative amino acid(s) | Previously known SNP? |
|---|---|---|
| 23 | A -> V | Yes |

Variant protein T99080_PEA_4_P15 (SEQ ID NO:1367) is encoded by the following transcript(s): T99080_PEA_4_T19 (SEQ ID NO:94), for which the sequence(s) is/are given at the end of the application. The coding portion of transcript T99080_PEA_4_T19 (SEQ ID NO:94) is shown in bold; this coding portion starts at position 226 and ends at position 459. The transcript also has the following SNPs as listed in Table 768 (given according to their position on the nucleotide sequence, with the alternative nucleic acid listed; the last column indicates whether the SNP is known or not; the presence of known SNPs in variant protein T99080_PEA_4_P15 (SEQ ID NO:1367) sequence provides support for the deduced sequence of this variant protein according to the present invention).

TABLE 768

Nucleic acid SNPs

| SNP position on nucleotide sequence | Alternative nucleic acid | Previously known SNP? |
|---|---|---|
| 293 | C -> T | Yes |
| 488 | G -> T | Yes |
| 811 | A -> G | Yes |
| 891 | A -> C | Yes |
| 930 | -> A | No |

Variant protein T99080_PEA_4_P16 (SEQ ID NO:1368) according to the present invention has an amino acid sequence as given at the end of the application; it is encoded by transcript(s) T99080_PEA_4_T20 (SEQ ID NO:95). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P16 (SEQ ID NO:1368) also has the following non-silent SNPs (Single Nucleotide Polymorphisms) as listed in Table 769, (given according to their position(s) on the amino acid sequence, with the alternative amino acid(s) listed; the last column indicates whether the SNP is known or not; the presence of known SNPs in variant protein T99080_PEA_4_P16 (SEQ ID NO:1368) sequence provides support for the deduced sequence of this variant protein according to the present invention).

TABLE 769

Amino acid mutations

| SNP position(s) on amino acid sequence | Alternative amino acid(s) | Previously known SNP? |
|---|---|---|
| 23 | A -> V | Yes |

Variant protein T99080_PEA_4_P16 (SEQ ID NO:1368) is encoded by the following transcript(s): T99080_PEA_4_T20 (SEQ ID NO:95), for which the sequence(s) is/are given at the end of the application. The coding portion of transcript T99080_PEA_4_T20 (SEQ ID NO:95) is shown in bold; this coding portion starts at position 226 and ends at position 501. The transcript also has the following SNPs as listed in Table 770 (given according to their position on the nucleotide sequence, with the alternative nucleic acid listed; the last column indicates whether the SNP is known or not; the presence of known SNPs in variant protein T99080_PEA_4_P16 (SEQ ID NO:1368) sequence provides support for the deduced sequence of this variant protein according to the present invention).

TABLE 770

Nucleic acid SNPs

| SNP position on nucleotide sequence | Alternative nucleic acid | Previously known SNP? |
|---|---|---|
| 293 | C -> T | Yes |

Variant protein T99080_PEA_4_P17 (SEQ ID NO:1369) according to the present invention has an amino acid sequence as given at the end of the application; it is encoded by transcript(s) T99080_PEA_4_T21 (SEQ ID NO:96). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P17 (SEQ ID NO:1369) also has the following non-silent SNPs (Single Nucleotide Polymorphisms) as listed in Table 771, (given according to their position(s) on the amino acid sequence, with the alternative amino acid(s) listed; the last column indicates whether the SNP is known or not; the presence of known SNPs in variant protein T99080_PEA_4_P17 (SEQ ID NO:1369) sequence provides support for the deduced sequence of this variant protein according to the present invention).

TABLE 771

Amino acid mutations

| SNP position(s) on amino acid sequence | Alternative amino acid(s) | Previously known SNP? |
|---|---|---|
| 23 | A -> V | Yes |

Variant protein T99080_PEA_4_P17 (SEQ ID NO:1369) is encoded by the following transcript(s): T99080_PEA_4_T21 (SEQ ID NO:96), for which the sequence(s) is/are given at the end of the application. The coding portion of transcript T99080_PEA_4_T21 (SEQ ID NO:96) is shown in bold; this coding portion starts at position 226 and ends at position 426. The transcript also has the following SNPs as listed in Table 772 (given according to their position on the nucleotide sequence, with the alternative nucleic acid listed; the last column indicates whether the SNP is known or not; the presence of known SNPs in variant protein T99080_PEA_4_P17 (SEQ ID NO:1369) sequence provides support for the deduced sequence of this variant protein according to the present invention).

TABLE 772

Nucleic acid SNPs

| SNP position on nucleotide sequence | Alternative nucleic acid | Previously known SNP? |
|---|---|---|
| 293 | C -> T | Yes |

As noted above, cluster T99080 features 11 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T99080_PEA_4_node_1 (SEQ ID NO:695) according to the present invention is supported by 5 libraries. The number of libraries was determined as previously described. This segment can be found in the following transcript(s): T99080_PEA_4_T0 (SEQ ID NO:83), T99080_PEA_4_T6 (SEQ ID NO:86), T99080_PEA_4_T13 (SEQ ID NO:90), T99080_PEA_4_T18 (SEQ ID NO:93), T99080_PEA_4_T19 (SEQ ID NO:94), T99080_PEA_4_T20 (SEQ ID NO:95) and T99080_PEA_4_T21 (SEQ ID NO:96). Table 773 below describes the starting and ending position of this segment on each transcript.

TABLE 773

Segment location on transcripts

| Transcript name | Segment starting position | Segment ending position |
|---|---|---|
| T99080_PEA_4_T0 (SEQ ID NO: 83) | 1 | 307 |
| T99080_PEA_4_T6 (SEQ ID NO: 86) | 1 | 307 |
| T99080_PEA_4_T13 (SEQ ID NO: 90) | 1 | 307 |
| T99080_PEA_4_T18 (SEQ ID NO: 93) | 1 | 307 |
| T99080_PEA_4_T19 (SEQ ID NO: 94) | 1 | 307 |
| T99080_PEA_4_T20 (SEQ ID NO: 95) | 1 | 307 |
| T99080_PEA_4_T21 (SEQ ID NO: 96) | 1 | 307 |

Segment cluster T99080_PEA_4_node_6 (SEQ ID NO:696) according to the present invention is supported by 3 libraries. The number of libraries was determined as previously described. This segment can be found in the following transcript(s): T99080_PEA_4_T17 (SEQ ID NO:92) and T99080_PEA_4_T21 (SEQ ID NO:96). Table 774 below describes the starting and ending position of this segment on each transcript.

TABLE 774

Segment location on transcripts

| Transcript name | Segment starting position | Segment ending position |
|---|---|---|
| T99080_PEA_4_T17 (SEQ ID NO: 92) | 181 | 627 |
| T99080_PEA_4_T21 (SEQ ID NO: 96) | 400 | 846 |

Segment cluster T99080_PEA_4_node_11 (SEQ ID NO:697) according to the present invention is supported by 7 libraries. The number of libraries was determined as previously described. This segment can be found in the following transcript(s): T99080_PEA_4_T14 (SEQ ID NO:91) and T99080_PEA_4_T20 (SEQ ID NO:95). Table 775 below describes the starting and ending position of this segment on each transcript.

TABLE 775

Segment location on transcripts

| Transcript name | Segment starting position | Segment ending position |
|---|---|---|
| T99080_PEA_4_T14 (SEQ ID NO: 91) | 260 | 782 |
| T99080_PEA_4_T20 (SEQ ID NO: 95) | 479 | 1001 |

Segment cluster T99080_PEA_4_node_19 (SEQ ID NO:698) according to the present invention is supported by 59 libraries. The number of libraries was determined as previously described. This segment can be found in the following transcript(s): T99080_PEA_4_T0 (SEQ ID NO:83), T99080_PEA_4_T2 (SEQ ID NO:84) and T99080_PEA_4_T4 (SEQ ID NO:85). Table 776 below describes the starting and ending position of this segment on each transcript.

TABLE 776

Segment location on transcripts

| Transcript name | Segment starting position | Segment ending position |
|---|---|---|
| T99080_PEA_4_T0 (SEQ ID NO: 83) | 449 | 1736 |
| T99080_PEA_4_T2 (SEQ ID NO: 84) | 230 | 1517 |
| T99080_PEA_4_T4 (SEQ ID NO: 85) | 78 | 1365 |

Segment cluster T99080_PEA_4_node_20 (SEQ ID NO:699) according to the present invention is supported by 98 libraries. The number of libraries was determined as previously described. This segment can be found in the following transcript(s): T99080_PEA_4_T0 (SEQ ID NO:83), T99080_PEA_4_T2 (SEQ ID NO:84), T99080_PEA_4_T4 (SEQ ID NO:85), T99080_PEA_4_T6 (SEQ ID NO:86), T99080_PEA_4_T9 (SEQ ID NO:87), T99080_PEA_4_T10 (SEQ ID NO:88), T99080_PEA_4_T11 (SEQ ID NO:89), T99080_PEA_4_T13 (SEQ ID NO:90), T99080_PEA_4_T18 (SEQ ID NO:93) and T99080_PEA_4_T19 (SEQ ID NO:94). Table 777 below describes the starting and ending position of this segment on each transcript.

TABLE 777

Segment location on transcripts

| Transcript name | Segment starting position | Segment ending position |
|---|---|---|
| T99080_PEA_4_T0 (SEQ ID NO: 83) | 1737 | 2175 |
| T99080_PEA_4_T2 (SEQ ID NO: 84) | 1518 | 1956 |
| T99080_PEA_4_T4 (SEQ ID NO: 85) | 1366 | 1804 |
| T99080_PEA_4_T6 (SEQ ID NO: 86) | 400 | 838 |
| T99080_PEA_4_T9 (SEQ ID NO: 87) | 168 | 606 |
| T99080_PEA_4_T10 (SEQ ID NO: 88) | 260 | 698 |
| T99080_PEA_4_T11 (SEQ ID NO: 89) | 295 | 733 |
| T99080_PEA_4_T13 (SEQ ID NO: 90) | 308 | 746 |
| T99080_PEA_4_T18 (SEQ ID NO: 93) | 479 | 917 |
| T99080_PEA_4_T19 (SEQ ID NO: 94) | 514 | 952 |

According to an optional embodiment of the present invention, short segments related to the above cluster are also provided. These segments are up to about 120 bp in length, and so are included in a separate description.

Segment cluster T99080_PEA_4_node_3 (SEQ ID NO:700) according to the present invention is supported by 40 libraries. The number of libraries was determined as previously described. This segment can be found in the following transcript(s): T99080_PEA_4_T2 (SEQ ID NO:84), T99080_PEA_4_T9 (SEQ ID NO:87), T99080_PEA_4_T10 (SEQ ID NO:88), T99080_PEA_4_T11 (SEQ ID NO:89), T99080_PEA_4_T14 (SEQ ID NO:91) and T99080_PEA_4_T17 (SEQ ID NO:92). Table 778 below describes the starting and ending position of this segment on each transcript.

TABLE 778

Segment location on transcripts

| Transcript name | Segment starting position | Segment ending position |
|---|---|---|
| T99080_PEA_4_T2 (SEQ ID NO: 84) | 1 | 88 |
| T99080_PEA_4_T9 (SEQ ID NO: 87) | 1 | 88 |
| T99080_PEA_4_T10 (SEQ ID NO: 88) | 1 | 88 |
| T99080_PEA_4_T11 (SEQ ID NO: 89) | 1 | 88 |
| T99080_PEA_4_T14 (SEQ ID NO: 91) | 1 | 88 |
| T99080_PEA_4_T17 (SEQ ID NO: 92) | 1 | 88 |

Segment cluster T99080_PEA_4_node_5 (SEQ ID NO:701) according to the present invention is supported by 57 libraries. The number of libraries was determined as previously described. This segment can be found in the following transcript(s): T99080_PEA_4_T0 (SEQ ID NO:83), T99080_PEA_4_T2 (SEQ ID NO:84), T99080_PEA_4_T6 (SEQ ID NO:86), T99080_PEA_4_T10 (SEQ ID NO:88), T99080_PEA_4_T11 (SEQ ID NO:89), T99080_PEA_4_T14 (SEQ ID NO:91), T99080_PEA_4_T17 (SEQ ID NO:92), T99080_PEA_4_T18 (SEQ ID NO:93), T99080_PEA_4_T19 (SEQ ID NO:94), T99080_PEA_4_T20 (SEQ ID NO:95) and T99080_PEA_4_T21 (SEQ ID NO:96). Table 779 below describes the starting and ending position of this segment on each transcript.

TABLE 779

Segment location on transcripts

| Transcript name | Segment starting position | Segment ending position |
|---|---|---|
| T99080_PEA_4_T0 (SEQ ID NO: 83) | 308 | 399 |
| T99080_PEA_4_T2 (SEQ ID NO: 84) | 89 | 180 |
| T99080_PEA_4_T6 (SEQ ID NO: 86) | 308 | 399 |
| T99080_PEA_4_T10 (SEQ ID NO: 88) | 89 | 180 |
| T99080_PEA_4_T11 (SEQ ID NO: 89) | 89 | 180 |
| T99080_PEA_4_T14 (SEQ ID NO: 91) | 89 | 180 |
| T99080_PEA_4_T17 (SEQ ID NO: 92) | 89 | 180 |
| T99080_PEA_4_T18 (SEQ ID NO: 93) | 308 | 399 |
| T99080_PEA_4_T19 (SEQ ID NO: 94) | 308 | 399 |
| T99080_PEA_4_T20 (SEQ ID NO: 95) | 308 | 399 |
| T99080_PEA_4_T21 (SEQ ID NO: 96) | 308 | 399 |

Segment cluster T99080_PEA_4_node_8 (SEQ ID NO:702) according to the present invention is supported by 12 libraries. The number of libraries was determined as previously described. This segment can be found in the following transcript(s): T99080_PEA_4_T9 (SEQ ID NO:87), T99080_PEA_4_T10 (SEQ ID NO:88), T99080_PEA_4_T14 (SEQ ID NO:91), T99080_PEA_4_T18 (SEQ ID NO:93) and T99080_PEA_4_T20 (SEQ ID NO:95). Table 780 below describes the starting and ending position of this segment on each transcript.

TABLE 780

Segment location on transcripts

| Transcript name | Segment starting position | Segment ending position |
|---|---|---|
| T99080_PEA_4_T9 (SEQ ID NO: 87) | 89 | 167 |
| T99080_PEA_4_T10 (SEQ ID NO: 88) | 181 | 259 |
| T99080_PEA_4_T14 (SEQ ID NO: 91) | 181 | 259 |
| T99080_PEA_4_T18 (SEQ ID NO: 93) | 400 | 478 |
| T99080_PEA_4_T20 (SEQ ID NO: 95) | 400 | 478 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 781.

TABLE 781

Oligonucleotides related to this segment

| Oligonucleotide name | Overexpressed in cancers | Chip reference |
|---|---|---|
| T99080_0_0_58896 | lung malignant tumors | LUN |

Segment cluster T99080_PEA_4_node_13 (SEQ ID NO:703) according to the present invention is supported by 2 libraries. The number of libraries was determined as previously described. This segment can be found in the following transcript(s): T99080_PEA_4_T4 (SEQ ID NO:85). Table 782 below describes the starting and ending position of this segment on each transcript.

TABLE 782

Segment location on transcripts

| Transcript name | Segment starting position | Segment ending position |
|---|---|---|
| T99080_PEA_4_T4 (SEQ ID NO: 85) | 1 | 77 |

Segment cluster T99080_PEA_4_node_15 (SEQ ID NO:704) according to the present invention is supported by 6 libraries. The number of libraries was determined as previously described. This segment can be found in the following transcript(s): T99080_PEA_4_T11 (SEQ ID NO:89) and T99080_PEA_4_T19 (SEQ ID NO:94). Table 783 below describes the starting and ending position of this segment on each transcript.

TABLE 783

Segment location on transcripts

| Transcript name | Segment starting position | Segment ending position |
|---|---|---|
| T99080_PEA_4_T11 (SEQ ID NO: 89) | 181 | 294 |
| T99080_PEA_4_T19 (SEQ ID NO: 94) | 400 | 513 |

Segment cluster T99080_PEA_4_node_18 (SEQ ID NO:705) according to the present invention is supported by 5 libraries. The number of libraries was determined as previously described. This segment can be found in the following transcript(s): T99080_PEA_4_T0 (SEQ ID NO:83) and T99080_PEA_4_T2 (SEQ ID NO:84). Table 784 below describes the starting and ending position of this segment on each transcript.

TABLE 784

Segment location on transcripts

| Transcript name | Segment starting position | Segment ending position |
|---|---|---|
| T99080_PEA_4_T0 (SEQ ID NO: 83) | 400 | 448 |
| T99080_PEA_4_T2 (SEQ ID NO: 84) | 181 | 229 |

Variant Protein Alignment to the Previously Known Protein:
Sequence name: ACYO_HUMAN_V1 (SEQ ID NO:1441)
Sequence documentation:
Alignment of: T99080_PEA_4_P5 (SEQ ID NO:1360) x ACYO_HUMAN_V1 (SEQ ID NO:1441) ..
Alignment segment 1/1:

| | | | |
|---|---|---|---|
| Quality: | 973.00 | Escore: | 0 |
| Matching length: | 99 | Total length: | 99 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 31  MAEGNTLISVDYEIFGKVQGVFFRKHTQAEGKKLGLVGWVQNTDRGTVQG   80
     |||||||||||||||||||||||||||||||||||||||||||||||||
  1  MAEGNTLISVDYEIFGKVQGVFFRKHTQAEGKKLGLVGWVQNTDRGTVQG   50

81  QLQGPISKVRHMQEWLETRGSPKSHIDKANFNNEKVILKLDYSDFQIVK   129
     ||||||||||||||||||||||||||||||||||||||||||||||||
 51  QLQGPISKVRHMQEWLETRGSPKSHIDKANFNNEKVILKLDYSDFQIVK    99
```

Sequence name: ACYO_HUMAN_V1 (SEQ ID NO:1441)
Sequence documentation:
    Alignment of: T99080_PEA__4_P8 (SEQ ID NO:1361) x ACYO_HUMAN_V1 (SEQ ID NO:1441) ..
Alignment segment 1/1:

| | | | |
|---|---|---|---|
| Quality: | 711.00 | Escore: | 0 |
| Matching length: | 72 | Total length: | 72 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 2  QAEGKKLGLVGWVQNTDRGTVQGQLQGPISKVRHMQEWLETRGSPKSHID  51
    |||||||||||||||||||||||||||||||||||||||||||||||||
28  QAEGKKLGLVGWVQNTDRGTVQGQLQGPISKVRHMQEWLETRGSPKSHID  77

52  KANFNNEKVILKLDYSDFQIVK  73
    ||||||||||||||||||||||
78  KANFNNEKVILKLDYSDFQIVK  99
```

Description for Cluster T08446

Cluster T08446 features 2 transcript(s) and 36 segment(s) of interest, the names for which are given in Tables 785 and 786, respectively, the sequences themselves are given at the end of the application. The selected protein variants are given in table 787.

TABLE 785

Transcripts of interest

| Transcript Name | Sequence ID No. |
|---|---|
| T08446_PEA_1_T2 | 97 |
| T08446_PEA_1_T22 | 98 |

TABLE 786

Segments of interest

| Segment Name | Sequence ID No. |
|---|---|
| T08446_PEA_1_node_2 | 706 |
| T08446_PEA_1_node_9 | 707 |
| T08446_PEA_1_node_15 | 708 |
| T08446_PEA_1_node_17 | 709 |
| T08446_PEA_1_node_25 | 710 |
| T08446_PEA_1_node_29 | 711 |
| T08446_PEA_1_node_38 | 712 |
| T08446_PEA_1_node_43 | 713 |
| T08446_PEA_1_node_51 | 714 |
| T08446_PEA_1_node_52 | 715 |
| T08446_PEA_1_node_55 | 716 |
| T08446_PEA_1_node_57 | 717 |
| T08446_PEA_1_node_59 | 718 |
| T08446_PEA_1_node_62 | 719 |
| T08446_PEA_1_node_63 | 720 |
| T08446_PEA_1_node_3 | 721 |
| T08446_PEA_1_node_5 | 722 |
| T08446_PEA_1_node_7 | 723 |
| T08446_PEA_1_node_12 | 724 |
| T08446_PEA_1_node_13 | 725 |

TABLE 786-continued

Segments of interest

| Segment Name | Sequence ID No. |
|---|---|
| T08446_PEA_1_node_19 | 726 |
| T08446_PEA_1_node_21 | 727 |
| T08446_PEA_1_node_23 | 728 |
| T08446_PEA_1_node_27 | 729 |
| T08446_PEA_1_node_32 | 730 |
| T08446_PEA_1_node_34 | 731 |
| T08446_PEA_1_node_45 | 732 |
| T08446_PEA_1_node_46 | 733 |
| T08446_PEA_1_node_48 | 734 |
| T08446_PEA_1_node_54 | 735 |

TABLE 786-continued

Segments of interest

| Segment Name | Sequence ID No. |
|---|---|
| T08446_PEA_1_node_58 | 736 |
| T08446_PEA_1_node_60 | 737 |
| T08446_PEA_1_node_61 | 738 |
| T08446_PEA_1_node_64 | 739 |
| T08446_PEA_1_node_65 | 740 |
| T08446_PEA_1_node_66 | 741 |

TABLE 787

Proteins of interest

| Protein Name | Sequence ID No. | Corresponding Transcript(s) |
|---|---|---|
| T08446_PEA_1_P18 | 1370 | T08446_PEA_1_T2 (SEQ ID NO: 97) |
| T08446_PEA_1_P19 | 1371 | T08446_PEA_1_T22 (SEQ ID NO: 98) |

These sequences are variants of the known protein Sorting nexin 26 (SwissProt accession identifier SNXQ_HUMAN), SEQ ID NO: 1442, referred to herein as the previously known protein.

Protein Sorting nexin 26 (SEQ ID NO:1442) is known or believed to have the following function(s): May be involved in several stages of intracellular trafficking (By similarity). The sequence for protein Sorting nexin 26 is given at the end of the application, as "Sorting nexin 26 amino acid sequence".

The following GO Annotation(s) apply to the previously known protein. The following annotation(s) were found: intracellular protein traffic, which are annotation(s) related to Biological Process; and protein transporter, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

As noted above, cluster T08446 features 2 transcript(s), which were listed in Table 1 above. These transcript(s) encode for protein(s) which are variant(s) of protein Sorting nexin 26 (SEQ ID NO:1442). A description of each variant protein according to the present invention is M78076_PEA_1_T13 (SEQ ID NO:77), M78076_PEA_1_T15 (SEQ ID NO:78), invention has an amino acid sequence as given at the end of the application; it is encoded by transcript(s) T08446_PEA_1_T2 (SEQ ID NO:97). An alignment is given to the known protein (Sorting nexin 26 (SEQ ID NO:1442)) at the end of the application. One or more alignments to one or more previously published protein sequences are given at the end of the application. A brief description of the relationship of the variant protein according to the present invention to each such aligned protein is as follows:

Comparison Report Between T08446_PEA_1_P18 (SEQ ID NO:1370) and SNXQ_HUMAN (SEQ ID NO:1442):

1. An isolated chimeric polypeptide encoding for T08446_PEA_1_P18 (SEQ ID NO:1370), comprising a first amino acid sequence being at least 90% homologous to MLSLSLCSHLWGPLILSALQARSTD-SLDGPGEGSVQPLPTAGGPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPP-PPEGARAAQMLVPLLLQYLETLSGLVDSNLNC GPVLTWME corresponding to amino acids 1-185 of SNXQ_HUMAN (SEQ ID NO:1442), which also corresponds to amino acids 1-185 of T08446_PEA_1_P18 (SEQ ID NO:1370), and a second amino acid sequence being at least 70%, optionally at least 80%, preferably at least 85%, more preferably at least 90% and most preferably at least 95% homologous to a polypeptide having the sequence LDNHGRRLLLSEEA-SLNIPAVAAAHVIKRYTAQAPDELSFE-VGDIVSVIDMPPTEDRSW WRGKRGFQVGFF-PSECVELFTERPGPGLKADADGPPCGIPAPQGISS LTSAVPRPRGKLA GLLRTFMRSRPSRQRLRQRGIL-RQRVFGCDLGEHLSNSGQDVPQVL-RCCSEFIEAHGVV DGIYRLSGVSSNIQRLRHEFD-SERIPELSGPAFLQDIHSVSSLCKLYFRELPNPLLTYQLY GKFSEAMSVPGEEERLVRVHDVIQQLPP-PHYRTLEYLLRHLARMARHSANTSMHARNL AIVWAPNLLRSMELESVGMG-GAAAFREVRVQSVVVEFLLTHVDVLFS-DTFTSAGLDPA GRCLLPRPKSLAGSCPSTRLLTLEE-AQARTQGRLGTPTEPTTPKAPASPAERRKGERGEK QRKPGGSSWKTFFALGRGPSVPRKKPLP-WLGGTRAPPQPSGSRPDTVTLRSAKSEESLS SQAS-GAGLQRLHRLRRPHSSSDAFPVGPAPAG-SCESLSSSSSSESSSSESSSSSSESSAAGL GALSGSPSHRTSAWLDDGDELDFSPPRC-LEGLRGLDFDPLTFRCSSPTPGDPAPPASPAP PAPASA-FPPRVTPQAISPRGPTSPASPAALDIS-EPLAVSVPPAVLELLGAGGAPASATPTP ALSPGRSLRPHLIPLLLRGAEAPLTDAC-QQEMCSKLRGAQGPLGPDMESPLPPPPLSLLR PGGAPPPPPKNPARLMALALAERAQQ-VAEQQSQQECGGTPPASQSPFHRSLSLEVGGEP LGTSGSGPPPNSLAHPGAWVPGPPPYL-PRQQSDGSLLRSQRPMGTSRRGLRGPAQVSAQ LRAGGGGRDAPEAAAQSPCSVPSQVPT-PGFFSPAPRECLPPFLGVPKPGLYPLGPPSFQP SSPA-PVWRSSLGPPAPLDRGENLYYEIGASEG-SPYSGPTRSWSPFRSMPPDRLNASYGM LGQSPPLHRSPDFLLSYPPAPSCFPP-DHLGYSAPQHPARRPTPPEPLYVNLALGPRGPSPA SSSSSSPPAHPRSRSDPGP-PVPRLPQKQRAPWGPRTPHRVPGPWG-PPEPLLLYRAAPPAY GRGGELHRGSLYRNGGQRGE-GAGPPPPYPTPSWSLHSEGQTRSYC (SEQ ID NO: 1733) corresponding to amino acids 186-1305 of T08446_PEA_1_P18 (SEQ ID NO:1370), wherein said first amino acid sequence and second amino acid sequence are contiguous and in a sequential order.

2. An isolated polypeptide encoding for a tail of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence LDNHGRRLLLSEEASLNIPAVAAAH-VIKRYTAQAPDELSFEVGDIVSVIDMPPTEDRSW WRGKRGFQVGFFPSECVELFTERPG-PGLKADADGPPCGIPAPQGISSLTSAVPRPRGKLA GLLRTFMRSRPSRQRLRQRGILRQRVF-GCDLGEHLSNSGQDVPQVLRCCSEFIEAHGVV DGIYRLSGVSSNIQRLRHEFD-SERIPELSGPAFLQDIHSVSSLCKLY-FRELPNPLLTYQLY GKFSEAMSVPGEEERLVRVHD-VIQQLPPPHYRTLEYLLRHLARMARHSANTSMHARNL AIVWAPNLLRSMELESVGMG-GAAAFREVRVQSVVVEFLLTHVDVLFS-DTFTSAGLDPA GRCLLPRPKSLAGSCPSTRLLTLEE-AQARTQGRLGTPTEPTTPKAPASPAERRKGERGEK QRKPGGSSWKTFFALGRGPSVPRKKPLP-WLGGTRAPPQPSGSRPDTVTLRSAKSEESLS SQAS-GAGLQRLHRLRRPHSSSDAFPVGPAPAG-SCESLSSSSSSESSSSESSSSSSESSAAGL GALSGSPSHRTSAWLDDGDELDFSPPRC-LEGLRGLDFDPLTFRCSSPTPGDPAPPASPAP PAPASA-FPPRVTPQAISPRGPTSPASPAALDIS-EPLAVSVPPAVLELLGAGGAPASATPTP ALSPGRSLRPHLIPLLLRGAEAPLTDAC-QQEMCSKLRGAQGPLGPDMESPLPPPPLSLLR PGGAPPPPPKNPARLMALALAERAQQ-VAEQQSQQECGGTPPASQSPFHRSLSLEVGGEP LGTSGSGPPPNSLAHPGAWVPGPPPYL-PRQQSDGSLLRSQRPMGTSRRGLRGPAQVSAQ LRAGGGGRDAPEAAAQSPCSVPSQVPT-PGFFSPAPRECLPPFLGVPKPGLYPLGPPSFQP SSPA-PVWRSSLGPPAPLDRGENLYYEIGASEG-SPYSGPTRSWSPFRSMPPDRLNASYGM LGQSPPLHRSPDFLLSYPPAPSCFPP-DHLGYSAPQHPARRPTPPEPLYVNLALGPRGPSPA SSSSSSPPAHPRSRSDPGP-PVPRLPQKQRAPWGPRTPHRVPGPWG-PPEPLLLYRAAPPAY GRGGELHRGSLYRNGGQRGE-GAGPPPPYPTPSWSLHSEGQTRSYC (SEQ ID NO:1733) in T08446_PEA_1_P18 (SEQ ID NO:1370).

Comparison Report Between T08446_PEA_1_P18 (SEQ ID NO:1370) and Q9NT23 (SEQ ID NO:1443) (SEQ ID NO:1443):

1. An isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLIL-SALQARSTDSLDGPGEGSVQPLPTAG-GPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPP-PPEGARAAQMLVPLLLQYLETLSGLVDSNLNC GPV-LTWMELDNHGRRLLLSEEA-SLNIPAVAAAHVIKRYTAQAPDELSFEVGDIVSVIDM PPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSE FIEAHGVVDGIYRLSGVSSNIQRL-RHEFDSERIPELSGPAFLQDIHSVSSLCKLYFRELPNP LLTYQLYGKFSEAMSVPGEEERLVRV (SEQ ID NO:1734) corresponding to amino acids 1-443 of T08446_PEA_1_P18 (SEQ ID NO:1370), a second amino acid sequence being at least 90% homologous to HDVIQQLPPPHYRTLEYLLRHLARMAR-HSANTSMHARNLAIVWAPNLLRSMELESVG MGGAAAFREVRVQSVVVEFLLTHVDV-LFSDTFTSAGLDPAGRCLLPRPKSLAGSCPSTR LLTLEEAQARTQGRLGTPTEPTTPKA-PASPAERRKGERGEKQRKPGGSSWKTFFALGRG PSVPRKKPLPWLGGTRAPPQPSGSRP-DTVTLRSAKSEESLSSQASGAGLQRLHRLRRPHS SSDAFPVGPAPAG-SCESLSSSSSSESSSSESSSSSSESSAA-GLGALSGSPSHRTSAWLDDG DELDFSPPRCLEGLR-GLDFDPLTFRCSSPTPGDPAPPASPAPPAPASAFPPR VTPQAISPRG PTSPASPAALDISEPLAVSVPPAVLELL-GAGGAPASATPTPALSPGRSLRPHLIPLLLRGA EAPLT-DACQQEMCSKLRGAQGPLGPDMESPLPP-PPLSLLRPGGAPPPPPKNPARLMALA LAERAQQVAEQQSQQECGGTPPASQSPF-HRSLSLEVGGEPLGTSGSGPPPNSLAHPGAW VPGPP-PYLPRQQSDGSLLRSQRPMGTSRRGLRG-PAQVSAQLRAGGGGRDAPEAAAQSP CSVPSQVPTPGFFSPAPRECLPPFLGVP-KPGLYPLGPPSFQPSSPAPVWRSSLGPPAPLDR GEN-LYYEIGASEGSPYSG corresponding to amino acids 1-674 of Q9NT23 (SEQ ID NO:1443), which also corresponds to amino acids 444-1117 of T08446_PEA_1_P18 (SEQ ID NO:1370), a bridging amino acid P corresponding to amino acid 1118 of T08446_PEA_1_P18 (SEQ ID NO:1370), and a third amino acid sequence being at least 90% homologous to TRSWSPFRSMPPDRLNASYGMLGQSPPL-HRSPDFLLSYPPAPSCFPPDHLGYSAPQHPAR RPT-PPEPLYVNLALGPRGPSPASSSSSSP-PAHPRSRSDPGPPVPRLPQKQRAPWGPRTPHR VPGPWGPPEPLLLYRAAPPAYGRGGEL-HRGSLYRNGGQRGEGAGPPPPYPTPSWSLHS EGQTRSYC corresponding to amino acids 676-862 of Q9NT23 (SEQ ID NO:1443), which also corresponds to amino acids 1119-1305 of T08446_PEA_1_P18 (SEQ ID NO:1370), wherein said first amino acid sequence, second amino acid sequence, bridging amino acid and third amino acid sequence are contiguous and in a sequential order.

2. An isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTD-SLDGPGEGSVQPLPTAGGPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPP-PPEGARAAQMLVPLLLQYLETLSGLVDSNLNC GPV-LTWMELDNHGRRLLLSEEA-SLNIPAVAAAHVIKRYTAQAPDELSFEVGDIVSVIDM PPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSE FIEAHGVVDGIYRLSGVSSNIQRL-RHEFDSERIPELSGPAFLQDIHSVSSLCKLYFRELPNP LLTYQLYGKFSEAMSVPGEEERLVRV (SEQ ID NO:1734) of T08446_PEA_1_P18 (SEQ ID NO:1370).

Comparison Report Between T08446_PEA_1_P18 (SEQ ID NO:1370) and Q96CP3 (SEQ ID NO:1444) (SEQ ID NO:1444):

1. An isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLIL-SALQARSTDSLDGPGEGSVQPLPTAG-GPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPP-PPEGARAAQMLVPLLLQYLETLSGLVDSNLNC GPV-LTWMELDNHGRRLLLSEEA-SLNIPAVAAAHVIKRYTAQAPDELSFEVGDIVSVIDM PPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSE FIEAHGVVDGIYRLSGVSSNIQRL-RHEFDSERIPELSGPAFLQDIHSVSSLCKLYFRELPNP LLTYQLYGKFSEAMSVPGEEERLVRVHD-VIQQLPPPHYRTLEYLLRHLARMARHSANT SMHARNLAIVWAPNLLRSMELESVGMG-GAAAFREVRVQSVVVEFLLTHVDVLFSDTF TSA-GLDPAGRCLLPRPKSLAGSCPSTR-LLTLEEAQARTQGRLGTPTEPTTPKAPASPAER RKGERGEKQRKPGGSSWKTFFALGRGPS-VPRKKPLPWLGGTRAPPQPSGSRPDTVTLRS AKSEESLSSQASGAGLQRLHRLR-RPHSSSDAFPVGPAPAGSCESLSSSSSSESSSSESSSSS SESSAAGLGALSGSPSHRT-SAWLDDGDELDFSPPRCLEGLRGLDFD-PLTFRCSSPTPGDP APPASPAPPAPASAFPPRVT-PQAISPRGPTSPASPAALDISEPLAVSVPPAVLELL GAGGA PASATPTPALSPGRSLRPHLIPLLLR-GAEAPLTDACQQEMCSKLRGAQGPLGPDMESPLP PPPLSLLRPGGAPPPPPKNPARLMALA-LAERAQQVAEQQSQQECGGTPPASQSPFHRSLS LEVGGEPLGTSGSGPPPNSLAHP-GAWVPGPPPYLPRQQSDGSLLRSQRPMGTSRRG corresponding to amino acids 1-1010 of T08446_PEA_1_P18 (SEQ ID NO:1370), and a second amino acid sequence being at least 90% homologous to LRGPAQVSAQL-RAGGGGRDAPEAAAQSPCSVPSQVPTPG-FFSPAPRECLPPFLGVPKPG LYPLGPPSFQPSSPA-PVWRSSLGPPAPLDRGENLYYEIGASEGSPYSGPT RSWSPFRSMPP DRLNASYGMLGQSPPLHRSPDFLL-SYPPAPSCFPPDHLGYSAPQHPARRPTPPEPLYVNL ALGPRGPSPASSSSSSPPAHPRSRSDPG-PPVPRLPQKQRAPWGPRTPHRVPGPWGPPEPL LLYRAAPPAYGRGGELHRGSLYRNG-GQRGEGAGPPPPYPTPSWSLHSEGQTRSYC corresponding to amino acids 1-295 of Q96CP3 (SEQ ID NO:1444), which also corresponds to amino acids 1011-1305 of T08446_PEA_1_P18 (SEQ ID NO:1370), wherein said first amino acid sequence and second amino acid sequence are contiguous and in a sequential order.

2. An isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTD-SLDGPGEGSVQPLPTAGGPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPP-PPEGARAAQMLVPLLLQYLETLSGLVDSNLNC GPV-LTWMELDNHGRRLLLSEEA-SLNIPAVAAAHVIKRYTAQAPDELSFEVGDIVSVIDM PPTEDRSWWRGKRGFQVGFF-PSECVELFTERPGPGLKADADGPPCGI-PAPQGISSLTSAV PRPRGKLAGLLRTFMRSRPSRQRL-RQRGILRQRVFGCDLGEHLSNSGQDVPQVLRCCSE FIEAHGVVDGIYRLSGVSSNIQRL-RHEFDSERIPELSGPAFLQDIHSVSSLCKLYFRELPNP LLTYQLYGKFSEAMSVPGEEERLVRVHD-VIQQLPPPHYRTLEYLLRHLARMARHSANT SMHARNLAIVWAPNLLRSMELESVGMG-GAAAFREVRVQSVVVEFLLTHVDVLFSDTF TSA-GLDPAGRCLLPRPKSLAGSCPSTR-LLTLEEAQARTQGRLGTPTEPTTPKAPASPAER RKGERGEKQRKPGGSSWKTFFALGRGPS-VPRKKPLPWLGGTRAPPQPSGSRPDTVTLRS AKSEESLSSQASGAGLQRLHRLR-RPHSSSDAFPVGPAPAGSCESLSSSSSSESSSSESSSSS SESSAAGLGALSGSPSHRT-SAWLDDGDELDFSPPRCLEGLRGLDFD-PLTFRCSSPTPGDP APPASPAPPAPASAFPPRVT-PQAISPRGPTSPASPAALDISEPLAVSVPPAVLEL LGAGGA PASATPTPALSPGRSLRPHLIPLLLR-GAEAPLTDACQQEMCSKLRGAQGPLGPDMESPLP PPPLSLLRPGGAPPPPPKNPARLMALA-LAERAQQVAEQQSQQECGGTPPASQSPFHRSLS LEVGGEPLGTSGSGPPPNSLAHP-GAWVPGPPPYLPRQQSDGSLLRSQRPMGTSRRG of T08446_PEA_1_P18 (SEQ ID NO:1370).

Comparison Report Between T08446_PEA_1_P18 (SEQ ID NO:1370) and BAC86902 (SEQ ID NO:1445):

1. An isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLIL-SALQARSTDSLDGPGEGSVQPLPTAG-GPSVKGKPGKRLSAPRG Segment cluster M78076_PEA_1_node_50 (SEQ ID NO:690) according to the present DDFRSLDAHLHR-CIFDRRFSCLPELPPPPEGARAAQ corresponding to amino acids 1-154 of T08446_PEA_1_P18 (SEQ ID NO:1370), a second amino acid sequence being at least 90% homologous to MLVPLLLQYLETLSGLVDSNLNCGPV-LTWMELDNHGRRLLLSEEASLNIPAVAAAHVI KRYTAQAPDELSFEVGDIVSVIDMPPT-EDRSWWRGKRGFQVGFFPSECVELFTERPGPG LKADADGPPCGIPAPQGISSLT-SAVPRPRGKLAGLLRTFMRSRPSRQRL-RQRGILRQRVF GCDLGEHLSNSGQDVPQVLRCCSE-FIEAHGVVDGIYRLSGVSSNIQRLRHEFDSERIPEL SGPAFLQDIHSVSSLCKLYFRELPN-PLLTYQLYGKFSEAMSVPGEEERLVRVHDVIQQLP PPHYRTLEYLLRHLARMARHSANTSM-HARNLAIVWAPNLLRSMELESVGMGGAAAFR EVRVQSVVVEFLLTHVDVLFSDTFTSA-GLDPAGRCLLPRPKSLAGSCPSTRLLTLEEAQ ARTQGRLGTPTEPTTPKAPASPAER-RKGERGEKQRKPGGSSWKTFFALGRGPSVPRKKP LPWLGGTRAPPQPSGSRPDTVTLRSAK-SEESLSSQASGAGLQRLHRLRRPHSSSDAFPVG PAPAG-SCESLSSSSSSESSSSESSSSSSESSAA-GLGALSGSPSHRTSAWLDDGDELDFSPPR CLEGLR-GLDFDPLTFRCSSPTPGDPAPPASPAPPAPASAFPP RVTPQAISPRGPTSPASPAA LDISEPLAVSVPPAVLELL-GAGGAPASATPTPALSPGRSLRPHLI-PLLLRGAEAPLTDACQ QEMCSKLRGAQGPLGPD-MESPLPPPPLSLLRPGGAPPPPPKNPARLMALALAE RAQQVA EQQSQQECGGTPPASQSPF-HRSLSLEVGGEPLGTSGSGPPPNSLAHP-GAWVPGPPPYLPR QQSDGSLLRSQRPMGTSRRGL-RGPA corresponding to amino acids 1-861 of BAC86902 (SEQ ID NO:1445), which also corresponds to amino acids 155-1015 of T08446_PEA_1_P18 (SEQ ID NO:1370), a third amino acid sequence being at least 70%, optionally at least 80%, preferably at least 85%, more preferably at least 90% and most preferably at least 95% homologous to a polypeptide having the sequence QVSAQLRAGGGGRDA-PEAAAQSPCSVPS corresponding to amino acids 1016-1043 of T08446_PEA_1_P18 (SEQ ID NO:1370), a fourth amino acid sequence being at least 90% homologous to QVPTPGFFSPAPRECLPPFLGVPKPGLY-PLGPPSFQPSSPAPVWRSSLGPPAPLDRGENLY YEI-GASEGSPYSGPTRSWSPFRSMPPDRL-NASYGMLGQSPPLHRSPDFLLSYPPAPSCFPP DHLGYS corresponding to amino acids 862-989 of BAC86902 (SEQ ID NO:1445), which also corresponds to amino acids 1044-1171 of T08446_PEA_1_P18 (SEQ ID NO:1370), and a fifth amino acid sequence being at least 70%, optionally at least 80%, preferably at least 85%, more preferably at least 90% and most preferably at least 95% homologous to a polypeptide having the sequence APQH-PARRPTPPPEPLYVNLALGPRGPS-PASSSSSSPPAHPRSRSDPGPPVPRLPQKQRAP WGPRTPHRVPGPWGPPEPLLLYRAAP-PAYGRGGELHRGSLYRNGGQRGEGAGPPPPYP TPSWSLHSEGQTRSYC corresponding to amino acids 1172-1305 of T08446_PEA_1_P18 (SEQ ID NO:1370), wherein said first amino acid sequence, second amino acid sequence, third amino acid sequence, fourth amino acid sequence and fifth amino acid sequence are contiguous and in a sequential order.

2. An isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTD-SLDGPGEGSVQPLPTAGGPSVKGKPGKRLSAPRG PFPRLADCAHFHYENVDFGHIQLLLSP-DREGPSLSGENELVFGVQVTCQGRSWPVLRSY DDFRSLDAHLHRCIFDRRFSCLPELPPPPEGARAAQ of T08446_PEA_1_P18 (SEQ ID NO:1370).

3. An isolated polypeptide encoding for an edge portion of T08446_PEA_1_P18 (SEQ ID NO:1370), comprising an amino acid sequence being at least 70%, optionally at least about 80%, preferably at least about 85%, more preferably at least about 90% and most preferably at least about 95% homologous to the sequence encoding for QVSAQL-RAGGGGRDAPEAAAQSPCSVPS, corresponding to T08446_PEA_1_P18 (SEQ ID NO:1370).

4. An isolated polypeptide encoding for a tail of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence APQHPARRPTPPEPLYVNLALGPRGPS-PASSSSSSPPAHPRSRSDPGPPVPRLPQKQRAP WGPRTPHRVPGPWGPPEPLLLYRAAP-PAYGRGGELHRGSLYRNGGQRGEGAGPPPPYP TPSWSLHSEGQTRSYC in T08446_PEA_1_P18 (SEQ ID NO:1370).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T08446_PEA_1_P18 (SEQ ID NO:1370) also has the following non-silent SNPs (Single Nucleotide Polymorphisms) as listed in Table 788, (given according to their position(s) on the amino acid sequence, with the alternative amino acid(s) listed; the last column indicates whether the SNP is known or not; the presence of known SNPs in variant protein T08446_PEA_1_P18 (SEQ ID NO:1370) sequence provides support for the deduced sequence of this variant protein according to the present invention).

TABLE 788

Amino acid mutations

| SNP position(s) on amino acid sequence | Alternative amino acid(s) | Previously known SNP? |
|---|---|---|
| 714 | S -> C | Yes |
| 1000 | S -> N | No |
| 1273 | R -> S | No |
| 1274 | N -> H | No |

Variant protein T08446_PEA_1_P18 (SEQ ID NO:1370) is encoded by the following transcript(s): T08446_PEA_1_T2 (SEQ ID NO:97), for which the sequence(s) is/are given at the end of the application. The coding portion of transcript T08446_PEA_1_T2 (SEQ ID NO:97) is shown in bold; this coding portion starts at position 228 and ends at position 4142. The transcript also has the following SNPs as listed in Table 789 (given according to their position on the nucleotide sequence, with the alternative nucleic acid listed; the last column indicates whether the SNP is known or not; the presence of known SNPs in variant protein T08446_PEA_1_P18 (SEQ ID NO:1370) sequence provides support for the deduced sequence of this variant protein according to the present invention).

TABLE 789

Nucleic acid SNPs

| SNP position on nucleotide sequence | Alternative nucleic acid | Previously known SNP? |
|---|---|---|
| 212 | G -> A | Yes |
| 431 | C -> T | Yes |

TABLE 789-continued

Nucleic acid SNPs

| SNP position on nucleotide sequence | Alternative nucleic acid | Previously known SNP? |
|---|---|---|
| 809 | C -> T | Yes |
| 1547 | G -> A | Yes |
| 2368 | C -> G | Yes |
| 3226 | G -> A | No |
| 3284 | C -> G | Yes |
| 3377 | C -> T | Yes |
| 4046 | A -> C | No |
| 4047 | A -> C | No |

Variant protein T08446_PEA_1_P19 (SEQ ID NO:1371) according to the present invention has an amino acid sequence as given at the end of the application; it is encoded by transcript(s) T08446_PEA_1_T22 (SEQ ID NO:98). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T08446_PEA_1_P19 (SEQ ID NO:1371) also has the following non-silent SNPs (Single Nucleotide Polymorphisms) as listed in Table 790, (given according to their position(s) on the amino acid sequence, with the alternative amino acid(s) listed; the last column indicates whether the SNP is known or not; the presence of known SNPs in variant protein T08446_PEA_1_P19 (SEQ ID NO:1371) sequence provides support for the deduced sequence of this variant protein according to the present invention).

TABLE 790

Amino acid mutations

| SNP position(s) on amino acid sequence | Alternative amino acid(s) | Previously known SNP? |
|---|---|---|
| 194 | D -> G | Yes |

Variant protein T08446_PEA_1_P19 (SEQ ID NO:1371) is encoded by the following transcript(s): T08446_PEA_1_T22 (SEQ ID NO:98), for which the sequence(s) is/are given at the end of the application. The coding portion of transcript T08446_PEA_1_T22 (SEQ ID NO:98) is shown in bold; this coding portion starts at position 228 and ends at position 965. The transcript also has the following SNPs as listed in Table 791 (given according to their position on the nucleotide sequence, with the alternative nucleic acid listed; the last column indicates whether the SNP is known or not; the presence of known SNPs in variant protein T08446_PEA_1_P19 (SEQ ID NO:1371) sequence provides support for the deduced sequence of this variant protein according to the present invention).

TABLE 791

Nucleic acid SNPs

| SNP position on nucleotide sequence | Alternative nucleic acid | Previously known SNP? |
|---|---|---|
| 212 | G -> A | Yes |
| 431 | C -> T | Yes |
| 808 | A -> G | Yes |

As noted above, cluster T08446 features 36 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T08446_PEA_1_node_2 (SEQ ID NO:706) according to the present invention is supported by 1 libraries. The number of libraries was determined as previously described. This segment can be found in the following transcript(s): T08446_PEA_1_T2 (SEQ ID NO:97) and T08446_PEA_1_T22 (SEQ ID NO:98). Table 792 below describes the starting and ending position of this segment on each transcript.

TABLE 792

Segment location on transcripts

| Transcript name | Segment starting position | Segment ending position |
|---|---|---|
| T08446_PEA_1_T2 (SEQ ID NO: 97) | 1 | 287 |
| T08446_PEA_1_T22 (SEQ ID NO: 98) | 1 | 287 |

Segment cluster T08446_PEA_1_node_9 (SEQ ID NO:707) according to the present invention is supported by 17 libraries. The number of libraries was determined as previously described. This segment can be found in the following transcript(s): T08446_PEA_1_T2 (SEQ ID NO:97) and T08446_PEA_1_T22 (SEQ ID NO:98). Table 793 below describes the starting and ending position of this segment on each transcript.

TABLE 793

Segment location on transcripts

| Transcript name | Segment starting position | Segment ending position |
|---|---|---|
| T08446_PEA_1_T2 (SEQ ID NO: 97) | 552 | 689 |
| T08446_PEA_1_T22 (SEQ ID NO: 98) | 552 | 689 |

Segment cluster T08446_PEA_1_node_15 (SEQ ID NO:708) according to the present invention is supported by 0 libraries. The number of libraries was determined as previously described. This segment can be found in the following transcript(s): T08446_PEA_1_T22 (SEQ ID NO:98). Table 794 below describes the starting and ending position of this segment on each transcript.

TABLE 794

Segment location on transcripts

| Transcript name | Segment starting position | Segment ending position |
|---|---|---|
| T08446_PEA_1_T22 (SEQ ID NO: 98) | 829 | 968 |

Segment cluster T08446_PEA_1_node_17 (SEQ ID NO:709) according to the present invention is supported by 22 libraries. The number of libraries was determined as previously described. This segment can be found in the following transcript(s): T08446_PEA_1_T2 (SEQ ID NO:97). Table 794 below describes the starting and ending position of this segment on each transcript.

TABLE 794

Segment location on transcripts

| Transcript name | Segment starting position | Segment ending position |
|---|---|---|
| T08446_PEA_1_T2 (SEQ ID NO: 97) | 783 | 905 |

Segment cluster T08446_PEA_1_node_25 (SEQ ID NO:710) according to the present invention is supported by 24 libraries. The number of libraries was determined as previously described. This segment can be found in the following transcript(s): T08446_PEA_1_T2 (SEQ ID NO:97). Table 12 below describes the starting and ending position of this segment on each transcript.

TABLE 12

Segment location on transcripts

| Transcript name | Segment starting position | Segment ending position |
|---|---|---|
| T08446_PEA_1_T2 (SEQ ID NO: 97) | 1111 | 1263 |

Segment cluster T08446_PEA_1_node_29 (SEQ ID NO:711) according to the present invention is supported by 25 libraries. The number of libraries was determined as previously described. This segment can be found in the following transcript(s): T08446_PEA_1_T2 (SEQ ID NO:97). Table 795 below describes the starting and ending position of this segment on each transcript.

TABLE 795

Segment location on transcripts

| Transcript name | Segment starting position | Segment ending position |
|---|---|---|
| T08446_PEA_1_T2 (SEQ ID NO: 97) | 1367 | 1511 |

Segment cluster T08446_PEA_1_node_38 (SEQ ID NO:712) according to the present invention is supported by 20 libraries. The number of libraries was determined as previously described. This segment can be found in the following transcript(s): T08446_PEA_1_T2 (SEQ ID NO:97). Table 796 below describes the starting and ending position of this segment on each transcript.

TABLE 796

Segment location on transcripts

| Transcript name | Segment starting position | Segment ending position |
|---|---|---|
| T08446_PEA_1_T2 (SEQ ID NO: 97) | 1703 | 1848 |

Segment cluster T08446_PEA_1_node_43 (SEQ ID NO:713) according to the present invention is supported by 15 libraries. The number of libraries was determined as previously described. This segment can be found in the following transcript(s): T08446_PEA_1_T2 (SEQ ID NO:97). Table 797 below describes the starting and ending position of this segment on each transcript.

TABLE 797

Segment location on transcripts

| Transcript name | Segment starting position | Segment ending position |
|---|---|---|
| T08446_PEA_1_T2 (SEQ ID NO: 97) | 1849 | 2002 |

Segment cluster T08446_PEA_1_node_51 (SEQ ID NO:714) according to the present invention is supported by 19 libraries. The number of libraries was determined as previously described. This segment can be found in the following transcript(s): T08446_PEA_1_T2 (SEQ ID NO:97). Table 798 below describes the starting and ending position of this segment on each transcript.

TABLE 798

Segment location on transcripts

| Transcript name | Segment starting position | Segment ending position |
|---|---|---|
| T08446_PEA_1_T2 (SEQ ID NO: 97) | 2224 | 2571 |

Segment cluster T08446_PEA_1_node_52 (SEQ ID NO:715) according to the present invention is supported by 15 libraries. The number of libraries was determined as previously described. This segment can be found in the following transcript(s): T08446_PEA_1_T2 (SEQ ID NO:97). Table 799 below describes the starting and ending position of this segment on each transcript.

TABLE 799

Segment location on transcripts

| Transcript name | Segment starting position | Segment ending position |
|---|---|---|
| T08446_PEA_1_T2 (SEQ ID NO: 97) | 2572 | 2694 |

Segment cluster T08446_PEA_1_node_55 (SEQ ID NO:716) according to the present invention is supported by 21 libraries. The number of libraries was determined as previously described. This segment can be found in the following transcript(s): T08446_PEA_1_T2 (SEQ ID NO:97). Table 800 below describes the starting and ending position of this segment on each transcript.

TABLE 800

Segment location on transcripts

| Transcript name | Segment starting position | Segment ending position |
|---|---|---|
| T08446_PEA_1_T2 (SEQ ID NO: 97) | 2707 | 2883 |

Segment cluster T08446_PEA_1_node_57 (SEQ ID NO:717) according to the present invention is supported by 37 libraries. The number of libraries was determined as previously described. This segment can be found in the following transcript(s): T08446_PEA_1_T2 (SEQ ID NO:97). Table 801 below describes the starting and ending position of this segment on each transcript.

TABLE 801

Segment location on transcripts

| Transcript name | Segment starting position | Segment ending position |
|---|---|---|
| T08446_PEA_1_T2 (SEQ ID NO: 97) | 2884 | 3275 |

Segment cluster T08446_PEA_1_node_59 (SEQ ID NO:718) according to the present invention is supported by 36 libraries. The number of libraries was determined as previously described. This segment can be found in the following transcript(s): T08446_PEA_1_T2 (SEQ ID NO:97). Table 802 below describes the starting and ending position of this segment on each transcript.

TABLE 802

Segment location on transcripts

| Transcript name | Segment starting position | Segment ending position |
|---|---|---|
| T08446_PEA_1_T2 (SEQ ID NO: 97) | 3360 | 3670 |

Segment cluster T08446_PEA_1_node_62 (SEQ ID NO:719) according to the present invention is supported by 36 libraries. The number of libraries was determined as previously described. This segment can be found in the following transcript(s): T08446_PEA_1_T2 (SEQ ID NO:97). Table 803 below describes the starting and ending position of this segment on each transcript.

TABLE 803

Segment location on transcripts

| Transcript name | Segment starting position | Segment ending position |
|---|---|---|
| T08446_PEA_1_T2 (SEQ ID NO: 97) | 3783 | 3988 |

Segment cluster T08446_PEA_1_node_63 (SEQ ID NO:720) according to the present invention is supported by 64 libraries. The number of libraries was determined as previously described. This segment can be found in the following transcript(s): T08446_PEA_1_T2 (SEQ ID NO:97). Table 804 below describes the starting and ending position of this segment on each transcript.

TABLE 804

Segment location on transcripts

| Transcript name | Segment starting position | Segment ending position |
|---|---|---|
| T08446_PEA_1_T2 (SEQ ID NO: 97) | 3989 | 4414 |

According to an optional embodiment of the present invention, short segments related to the above cluster are also provided. These segments are up to about 120 bp in length, and so are included in a separate description.

Segment cluster T08446_PEA_1_node_3 (SEQ ID NO:721) according to the present invention is supported by 14 libraries. The number of libraries was determined as previously described. This segment can be found in the following transcript(s): T08446_PEA_1_T2 (SEQ ID NO:97) and T08446_PEA_1_T22 (SEQ ID NO:98). Table 805 below describes the starting and ending position of this segment on each transcript.

TABLE 805

Segment location on transcripts

| Transcript name | Segment starting position | Segment ending position |
|---|---|---|
| T08446_PEA_1_T2 (SEQ ID NO: 97) | 288 | 385 |
| T08446_PEA_1_T22 (SEQ ID NO: 98) | 288 | 385 |

Segment cluster T08446_PEA_1_node_5 (SEQ ID NO:722) according to the present invention is supported by 17 libraries. The number of libraries was determined as previously described. This segment can be found in the following transcript(s): T08446_PEA_1_T2 (SEQ ID NO:97) and T08446_PEA_1_T22 (SEQ ID NO:98). Table 806 below describes the starting and ending position of this segment on each transcript.

TABLE 806

Segment location on transcripts

| Transcript name | Segment starting position | Segment ending position |
|---|---|---|
| T08446_PEA_1_T2 (SEQ ID NO: 97) | 386 | 470 |
| T08446_PEA_1_T22 (SEQ ID NO: 98) | 386 | 470 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 807.

TABLE 807

Oligonucleotides related to this segment

| Oligonucleotide name | Overexpressed in cancers | Chip reference |
|---|---|---|
| T08446_0_9_0 | lung malignant tumors | LUN |

Segment cluster T08446_PEA_1_node_7 (SEQ ID NO:723) according to the present invention is supported by 19 libraries. The number of libraries was determined as previously described. This segment can be found in the following transcript(s): T08446_PEA_1_T2 (SEQ ID NO:97) and T08446_PEA_1_T22 (SEQ ID NO:98). Table 808 below describes the starting and ending position of this segment on each transcript.

TABLE 808

Segment location on transcripts

| Transcript name | Segment starting position | Segment ending position |
|---|---|---|
| T08446_PEA_1_T2 (SEQ ID NO: 97) | 471 | 551 |
| T08446_PEA_1_T22 (SEQ ID NO: 98) | 471 | 551 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 809.

TABLE 809

Oligonucleotides related to this segment

| Oligonucleotide name | Overexpressed in cancers | Chip reference |
|---|---|---|
| T08446_0_9_0 | lung malignant tumors | LUN |

Segment cluster T08446_PEA_1_node_12 (SEQ ID NO:724) according to the present invention is supported by 14 libraries. The number of libraries was determined as previously described. This segment can be found in the following transcript(s): T08446_PEA_1_T2 (SEQ ID NO:97) and T08446_PEA_1_T22 (SEQ ID NO:98). Table 810 below describes the starting and ending position of this segment on each transcript.

TABLE 810

Segment location on transcripts

| Transcript name | Segment starting position | Segment ending position |
|---|---|---|
| T08446_PEA_1_T2 (SEQ ID NO: 97) | 690 | 782 |
| T08446_PEA_1_T22 (SEQ ID NO: 98) | 690 | 782 |

Segment cluster T08446_PEA_1_node_13 (SEQ ID NO:725) according to the present invention is supported by 0 libraries. The number of libraries was determined as previously described. This segment can be found in the following transcript(s): T08446_PEA_1_T22 (SEQ ID NO:98). Table 811 below describes the starting and ending position of this segment on each transcript.

TABLE 811

Segment location on transcripts

| Transcript name | Segment starting position | Segment ending position |
| --- | --- | --- |
| T08446_PEA_1_T22 (SEQ ID NO: 98) | 783 | 828 |

Segment cluster T08446_PEA_1_node_19 (SEQ ID NO:726) according to the present invention is supported by 19 libraries. The number of libraries was determined as previously described. This segment can be found in the following transcript(s): T08446_PEA_1_T2 (SEQ ID NO:97). Table 812 below describes the starting and ending position of this segment on each transcript.

TABLE 812

Segment location on transcripts

| Transcript name | Segment starting position | Segment ending position |
| --- | --- | --- |
| T08446_PEA_1_T2 (SEQ ID NO: 97) | 906 | 983 |

Segment cluster T08446_PEA_1_node_21 (SEQ ID NO:727) according to the present invention is supported by 21 libraries. The number of libraries was determined as previously described. This segment can be found in the following transcript(s): T08446_PEA_1_T2 (SEQ ID NO:97). Table 813 below describes the starting and ending position of this segment on each transcript.

TABLE 813

Segment location on transcripts

| Transcript name | Segment starting position | Segment ending position |
| --- | --- | --- |
| T08446_PEA_1_T2 (SEQ ID NO: 97) | 984 | 1050 |

Segment cluster T08446_PEA_1_node_23 (SEQ ID NO:728) according to the present invention is supported by 22 libraries. The number of libraries was determined as previously described. This segment can be found in the following transcript(s): T08446_PEA_1_T2 (SEQ ID NO:97). Table 814 below describes the starting and ending position of this segment on each transcript.

TABLE 814

Segment location on transcripts

| Transcript name | Segment starting position | Segment ending position |
| --- | --- | --- |
| T08446_PEA_1_T2 (SEQ ID NO: 97) | 1051 | 1110 |

Segment cluster T08446_PEA_1_node_27 (SEQ ID NO:729) according to the present invention is supported by 23 libraries. The number of libraries was determined as previously described. This segment can be found in the following transcript(s): T08446_PEA_1_T2 (SEQ ID NO:97). Table 815 below describes the starting and ending position of this segment on each transcript.

TABLE 815

Segment location on transcripts

| Transcript name | Segment starting position | Segment ending position |
| --- | --- | --- |
| T08446_PEA_1_T2 (SEQ ID NO: 97) | 1264 | 1366 |

Segment cluster T08446_PEA_1_node_32 (SEQ ID NO:730) according to the present invention is supported by 23 libraries. The number of libraries was determined as previously described. This segment can be found in the following transcript(s): T08446_PEA_1_T2 (SEQ ID NO:97). Table 816 below describes the starting and ending position of this segment on each transcript.

TABLE 816

Segment location on transcripts

| Transcript name | Segment starting position | Segment ending position |
| --- | --- | --- |
| T08446_PEA_1_T2 (SEQ ID NO: 97) | 1512 | 1594 |

Segment cluster T08446_PEA_1_node_34 (SEQ ID NO:731) according to the present invention is supported by 22 libraries. The number of libraries was determined as previously described. This segment can be found in the following transcript(s): T08446_PEA_1_T2 (SEQ ID NO:97). Table 817 below describes the starting and ending position of this segment on each transcript.

TABLE 817

Segment location on transcripts

| Transcript name | Segment starting position | Segment ending position |
| --- | --- | --- |
| T08446_PEA_1_T2 (SEQ ID NO: 97) | 1595 | 1702 |

Segment cluster T08446_PEA_1_node_45 (SEQ ID NO:732) according to the present invention is supported by 19 libraries. The number of libraries was determined as previously described. This segment can be found in the following transcript(s): T08446_PEA_1_T2 (SEQ ID NO:97). Table 818 below describes the starting and ending position of this segment on each transcript.

TABLE 818

Segment location on transcripts

| Transcript name | Segment starting position | Segment ending position |
| --- | --- | --- |
| T08446_PEA_1_T2 (SEQ ID NO: 97) | 2003 | 2091 |

Segment cluster T08446_PEA_1_node_46 (SEQ ID NO:733) according to the present invention is supported by 18 libraries. The number of libraries was determined as previously described. This segment can be found in the following transcript(s): T08446_PEA_1_T2 (SEQ ID NO:97). Table 819 below describes the starting and ending position of this segment on each transcript.

TABLE 819

Segment location on transcripts

| Transcript name | Segment starting position | Segment ending position |
|---|---|---|
| T08446_PEA_1_T2 (SEQ ID NO: 97) | 2092 | 2148 |

Segment cluster T08446_PEA_1_node_48 (SEQ ID NO:734) according to the present invention is supported by 19 libraries. The number of libraries was determined as previously described. This segment can be found in the following transcript(s): T08446_PEA_1_T2 (SEQ ID NO:97). Table 820 below describes the starting and ending position of this segment on each transcript.

TABLE 820

Segment location on transcripts

| Transcript name | Segment starting position | Segment ending position |
|---|---|---|
| T08446_PEA_1_T2 (SEQ ID NO: 97) | 2149 | 2223 |

Segment cluster T08446_PEA_1_node_54 (SEQ ID NO:735) according to the present invention can be found in the following transcript(s): T08446_PEA_1_T2 (SEQ ID NO:97). Table 821 below describes the starting and ending position of this segment on each transcript.

TABLE 821

Segment location on transcripts

| Transcript name | Segment starting position | Segment ending position |
|---|---|---|
| T08446_PEA_1_T2 (SEQ ID NO: 97) | 2695 | 2706 |

Segment cluster T08446_PEA_1_node_58 (SEQ ID NO:736) according to the present invention is supported by 13 libraries. The number of libraries was determined as previously described. This segment can be found in the following transcript(s): T08446_PEA_1_T2 (SEQ ID NO:97). Table 822 below describes the starting and ending position of this segment on each transcript.

TABLE 822

Segment location on transcripts

| Transcript name | Segment starting position | Segment ending position |
|---|---|---|
| T08446_PEA_1_T2 (SEQ ID NO: 97) | 3276 | 3359 |

Segment cluster T08446_PEA_1_node_60 (SEQ ID NO:737) according to the present invention is supported by 27 libraries. The number of libraries was determined as previously described. This segment can be found in the following transcript(s): T08446_PEA_1_T2 (SEQ ID NO:97). Table 823 below describes the starting and ending position of this segment on each transcript.

TABLE 823

Segment location on transcripts

| Transcript name | Segment starting position | Segment ending position |
|---|---|---|
| T08446_PEA_1_T2 (SEQ ID NO: 97) | 3671 | 3720 |

Segment cluster T08446_PEA_1_node_61 (SEQ ID NO:738) according to the present invention is supported by 25 libraries. The number of libraries was determined as previously described. This segment can be found in the following transcript(s): T08446_PEA_1_T2 (SEQ ID NO:97). Table 824 below describes the starting and ending position of this segment on each transcript.

TABLE 824

Segment location on transcripts

| Transcript name | Segment starting position | Segment ending position |
|---|---|---|
| T08446_PEA_1_T2 (SEQ ID NO: 97) | 3721 | 3782 |

Segment cluster T08446_PEA_1_node_64 (SEQ ID NO:739) according to the present invention can be found in the following transcript(s): T08446_PEA_1_T2 (SEQ ID NO:97). Table 825 below describes the starting and ending position of this segment on each transcript.

TABLE 825

Segment location on transcripts

| Transcript name | Segment starting position | Segment ending position |
|---|---|---|
| T08446_PEA_1_T2 (SEQ ID NO: 97) | 4415 | 4420 |

Segment cluster T08446_PEA_1_node_65 (SEQ ID NO:740) according to the present invention is supported by 39 libraries. The number of libraries was determined as previously described. This segment can be found in the following transcript(s): T08446_PEA_1_T2 (SEQ ID NO:97). Table 826 below describes the starting and ending position of this segment on each transcript.

TABLE 826

Segment location on transcripts

| Transcript name | Segment starting position | Segment ending position |
|---|---|---|
| T08446_PEA_1_T2 (SEQ ID NO: 97) | 4421 | 4472 |

Segment cluster T08446_PEA_1_node_66 (SEQ ID NO:741) according to the present invention is supported by 29 libraries. The number of libraries was determined as previously described. This segment can be found in the following transcript(s): T08446_PEA_1_T2 (SEQ ID NO:97). Table 827 below describes the starting and ending position of this segment on each transcript.

TABLE 827

Segment location on transcripts

| Transcript name | Segment starting position | Segment ending position |
|---|---|---|
| T08446_PEA_1_T2 (SEQ ID NO: 97) | 4473 | 4539 |

Variant Protein Alignment to the Previously Known Protein:
Sequence name: SNXQ_HUMAN (SEQ ID NO:1442)
Sequence documentation:
Alignment of: T08446_PEA_1_P18 (SEQ ID NO:1370) x SNXQ_HUMAN (SEQ ID NO:1442)..
Alignment segment 1/1:

| Quality: | 1835.00 | Escore: | 0 |
|---|---|---|---|
| Matching length: | 185 | Total length: | 185 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MLSLSLCSHLWGPLILSALQARSTDSLDGPGEGSVQPLPTAGGPSVKGKP   50
     ||||||||||||||||||||||||||||||||||||||||||||||||||
  1  MLSLSLCSHLWGPLILSALQARSTDSLDGPGEGSVQPLPTAGGPSVKGKP   50

51  GKRLSAPRGPFPRLADCAHFHYENVDFGHIQLLLSPDREGPSLSGENELV  100
     ||||||||||||||||||||||||||||||||||||||||||||||||||
 51  GKRLSAPRGPFPRLADCAHFHYENVDFGHIQLLLSPDREGPSLSGENELV  100

101  FGVQVTCQGRSWPVLRSYDDFRSLDAHLHRCIFDRRFSCLPELPPPPEGA  150
     ||||||||||||||||||||||||||||||||||||||||||||||||||
101  FGVQVTCQGRSWPVLRSYDDFRSLDAHLHRCIFDRRFSCLPELPPPPEGA  150

151  RAAQMLVPLLLQYLETLSGLVDSNLNCGPVLTWME                185
     |||||||||||||||||||||||||||||||||||
151  RAAQMLVPLLLQYLETLSGLVDSNLNCGPVLTWME                185
```

Sequence name: Q9NT23 (SEQ ID NO:1443)
Sequence documentation:
Alignment of: T08446_PEA_1_P18 (SEQ ID NO:1370) x Q9NT23 (SEQ ID NO:1443)..
Alignment segment 1/1:

| Quality: | 8548.00 | Escore: | 0 |
|---|---|---|---|
| Matching length: | 862 | Total length: | 862 |
| Matching Percent Similarity: | 99.88 | Matching Percent Identity: | 99.88 |
| Total Percent Similarity: | 99.88 | Total Percent Identity: | 99.88 |
| Gaps: | 0 | | |

Alignment:

```
 444   HDVIQQLPPPHYRTLEYLLRHLARMARHSANTSMHARNLAIVWAPNLLRS    493
       ||||||||||||||||||||||||||||||||||||||||||||||||||
   1   HDVIQQLPPPHYRTLEYLLRHLARMARHSANTSMHARNLAIVWAPNLLRS     50

494   MELESVGMGGAAAFREVRVQSVVVEFLLTHVDVLFSDTFTSAGLDPAGRC    543
       ||||||||||||||||||||||||||||||||||||||||||||||||||
  51   MELESVGMGGAAAFREVRVQSVVVEFLLTHVDVLFSDTFTSAGLDPAGRC    100

544   LLPRPKSLAGSCPSTRLLTLEEAQARTQGRLGTPTEPTTPKAPASPAERR    593
       ||||||||||||||||||||||||||||||||||||||||||||||||||
 101   LLPRPKSLAGSCPSTRLLTLEEAQARTQGRLGTPTEPTTPKAPASPAERR    150

594   KGERGEKQRKPGGSSWKTFFALGRGPSVPRKKPLPWLGCTRAPPQPSGSR    643
       ||||||||||||||||||||||||||||||||||||||||||||||||||
 151   KGERGEKQRKPGGSSWKTFFALGRGPSVPRKKPLPWLGCTRAPPQPSGSR    200

644   PDTVTLRSAKSEESLSSQASGAGLQRLHRLRRPHSSSDAFPVGPAPAGSC    693
       ||||||||||||||||||||||||||||||||||||||||||||||||||
 201   PDTVTLRSAKSEESLSSQASGAGLQRLHRLRRPHSSSDAFPVGPAPAGSC    250

694   ESLSSSSSSESSSSESSSSSSESSAAGLGALSGSPSHRTSAWLDDGDELD    743
       ||||||||||||||||||||||||||||||||||||||||||||||||||
 251   ESLSSSSSSESSSSESSSSSSESSAAGLGALSGSPSHRTSAWLDDGDELD    300

744   FSPPRCLEGLRGLDFDPLTFRCSSPTPGDPAPPASPAPPAPASAFPPRVT    793
       ||||||||||||||||||||||||||||||||||||||||||||||||||
 301   FSPPRCLEGLRGLDFDPLTFRCSSPTPGDPAPPASPAPPAPASAFPPRVT    350

794   PQAISPRGPTSPASPAALDISEPLAVSVPPAVLELLGAGGAPASATPTPA    793
       ||||||||||||||||||||||||||||||||||||||||||||||||||
 351   PQAISPRGPTSPASPAALDISEPLAVSVPPAVLELLGAGGAPASATPTPA    350

844   LSPGRSLRPHLIPLLLRGAEAPLTDACQQEMCSKLRGAQGPLGPDMESPL    893
       ||||||||||||||||||||||||||||||||||||||||||||||||||
 401   LSPGRSLRPHLIPLLLRGAEAPLTDACQQEMCSKLRGAQGPLGPDMESPL    450

894   PPPPLSLLRPGGAPPPPPKNPARLMALALAERAQQVAEQQSQQECGGTPP    943
       ||||||||||||||||||||||||||||||||||||||||||||||||||
 451   PPPPLSLLRPGGAPPPPPKNPARLMALALAERAQQVAEQQSQQECGGTPP    500

944   ASQSPFHRSLSLEVGGEPLGTSGSGPPPNSLAHPGAWVPGPPPYLPRQQS    993
       ||||||||||||||||||||||||||||||||||||||||||||||||||
 501   ASQSPFHRSLSLEVGGEPLGTSGSGPPPNSLAHPGAWVPGPPPYLPRQQS    550

994   DGSLLRSQRPMGTSRRGLRGPAQVSAQLRAGGGGRDAPEAAAQSPCSVPS   1043
       ||||||||||||||||||||||||||||||||||||||||||||||||||
 551   DGSLLRSQRPMGTSRRGLRGPAQVSAQLRAGGGGRDAPEAAAQSPCSVPS    550

1044   QVPTPGFFSPAPRECLPPFLGVPKPGLYPLGPPSFQPSSPAPVWRSSLGP   1093
       ||||||||||||||||||||||||||||||||||||||||||||||||||
 601   QVPTPGFFSPAPRECLPPFLGVPKPGLYPLGPPSFQPSSPAPVWRSSLGP    650

1094   PAPLDRGENLYYEIGASEGSPYSGPTRSWSPFRSMPPDRLNASYGMLGQS   1143
       ||||||||||||||||||||||||||||||||||||||||||||||||||
 651   PAPLDRGENLYYEIGASEGSPYSGPTRSWSPFRSMPPDRLNASYGMLGQS    700

1144   PPLHRSPDFLLSYPPAPSCFPPDHLGYSAPQHPARRPTPPEPLYVNLALG   1193
       ||||||||||||||||||||||||||||||||||||||||||||||||||
 701   PPLHRSPDFLLSYPPAPSCFPPDHLGYSAPQHPARRPTPPEPLYVNLALG    750

1194   PRGPSPASSSSSSPPAHPRSRSDPGPPVPRLPQKQRAPWGPRTPHRVPGP   1243
       ||||||||||||||||||||||||||||||||||||||||||||||||||
 751   PRGPSPASSSSSSPPAHPRSRSDPGPPVPRLPQKQRAPWGPRTPHRVPGP    800

1244   WGPPEPLLLYRAAPPAYGRGGELHRGSLYRNGGQRGEGAGPPPPYPTPSW   1293
       ||||||||||||||||||||||||||||||||||||||||||||||||||
 801   WGPPEPLLLYRAAPPAYGRGGELHRGSLYRNGGQRGEGAGPPPPYPTPSW    850

1294   SLHSEGQTRSYC                                        1305
       ||||||||||||
 851   SLHSEGQTRSYC                                         862
```

Sequence name: Q96CP3 (SEQ ID NO:1444)

Sequence documentation:

Alignment of: T08446_PEA_1_P18 (SEQ ID NO:1370) x Q96CP3 (SEQ ID NO:1444) ..

Alignment segment 1/1:

| Quality: | 3019.00 | Escore: | 0 |
|---|---|---|---|
| Matching length: | 295 | Total length: | 295 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1011   LRGPAQVSAQLRAGGGGRDAPEAAAQSPCSVPSQVPTPGFFSPAPRECLP   1060
       |||||||||||||||||||||||||||||||||||||||||||||||||
   1   LRGPAQVSAQLRAGGGGRDAPEAAAQSPCSVPSQVPTPGFFSPAPRECLP     50

1061   PFLGVPKPGLYPLGPPSFQPSSPAPVWRSSLGPPAPLDRGENLYYEIGAS   1110
       |||||||||||||||||||||||||||||||||||||||||||||||||
  51   PFLGVPKPGLYPLGPPSFQPSSPAPVWRSSLGPPAPLDRGENLYYEIGAS    100

1111   EGSPYSGPTRSWSPFRSMPPDRLNASYGMLGQSPPLHRSPDFLLSYPPAP   1160
       |||||||||||||||||||||||||||||||||||||||||||||||||
 101   EGSPYSGPTRSWSPFRSMPPDRLNASYGMLGQSPPLHRSPDFLLSYPPAP    150

1161   SCFPPDHLGYSAPQHPARRPTPPEPLYVNLALGPRGPSPASSSSSSPPAH   1210
       |||||||||||||||||||||||||||||||||||||||||||||||||
 151   SCFPPDHLGYSAPQHPARRPTPPEPLYVNLALGPRGPSPASSSSSSPPAH    200

1211   PRSRSDPGPPVPRLPQKQRAPWGPRTPHRVPGPWGPPEPLLLYRAAPPAY   1260
       |||||||||||||||||||||||||||||||||||||||||||||||||
 201   PRSRSDPGPPVPRLPQKQRAPWGPRTPHRVPGPWGPPEPLLLYRAAPPAY    250

1261   GRGGELHRGSLYRNGGQRGEGAGPPPPYPTPSWSLHSEGQTRSYC   1305
       |||||||||||||||||||||||||||||||||||||||||||||
 251   GRGGELHRGSLYRNGGQRGEGAGPPPPYPTPSWSLHSEGQTRSYC    295
```

Sequence name: BAC86902 (SEQ ID NO:1445)
Sequence documentation:
Alignment of: T08446_PEA_1_P18 (SEQ ID NO:1370) x BAC86902 (SEQ ID NO:1445) ..
Alignment segment 1/1:

| Quality: | 9651.00 | Escore: | 0 |
|---|---|---|---|
| Matching length: | 991 | Total length: | 1019 |
| Matching Percent Similarity: | 99.90 | Matching Percent Identity: | 99.90 |
| Total Percent Similarity: | 97.15 | Total Percent Identity: | 97.15 |
| Gaps: | 1 | | |

Alignment:

```
 155   MLVPLLLQYLETLSGLVDSNLNCGPVLTWMELDNHGRRLLLSEEASLNIP    204
       |||||||||||||||||||||||||||||||||||||||||||||||||
   1   MLVPLLLQYLETLSGLVDSNLNCGPVLTWMELDNHGRRLLLSEEASLNIP     50

205   AVAAAHVIKRYTAQAPDELSFEVGDIVSVIDMPPTEDRSWWRGKRGFQVG    254
       |||||||||||||||||||||||||||||||||||||||||||||||||
  51   AVAAAHVIKRYTAQAPDELSFEVGDIVSVIDMPPTEDRSWWRGKRGFQVG    100

255   FFPSECVELFTERPGPGLKADADGPPCGIPAPQGISSLTSAVPRPRGKLA    304
       |||||||||||||||||||||||||||||||||||||||||||||||||
 101   FFPSECVELFTERPGPGLKADADGPPCGIPAPQGISSLTSAVPRPRGKLA    150
```

```
-continued

305  GLLRTFMRSRPSRQRLRQRGILRQRVFGCDLGEHLSNSGQDVPQVLRCCS   354
      ||||||||||||||||||||||||||||||||||||||||||||||||||
 151  GLLRTFMRSRPSRQRLRQRGILRQRVFGCDLGEHLSNSGQDVPQVLRCCS   200

355  EFIEAHGVVDGIYRLSGVSSNIQRLRHEFDSERIPELSGPAFLQDIHSVS   404
      ||||||||||||||||||||||||||||||||||||||||||||||||||
 201  EFIEAHGVVDGIYRLSGVSSNIQRLRHEFDSERIPELSGPAFLQDIHSVS   250

405  SLCKLYFRELPNPLLTYQLYGKFSEAMSVPGEEERLVRVHDVIQQLPPPH   454
      ||||||||||||||||||||||||||||||||||||||||||||||||||
 251  SLCKLYFRELPNPLLTYQLYGKFSEAMSVPGEEERLVRVHDVIQQLPPPH   300

455  YRTLEYLLRHLARMARHSANTSMHARNLAIVWAPNLLRSMELESVGMGGA   504
      ||||||||||||||||||||||||||||||||||||||||||||||||||
 301  YRTLEYLLRHLARMARHSANTSMHARNLAIVWAPNLLRSMELESVGMGGA   350

505  AAFREVRVQSVVVEFLLTHVDVLFSDTFTSAGLDPAGRCLLPRPKSLAGS   554
      ||||||||||||||||||||||||||||||||||||||||||||||||||
 351  AAFREVRVQSVVVEFLLTHVDVLFSDTFTSAGLDPAGRCLLPRPKSLAGS   400

555  CPSTRLLTLEEAQARTQGRLGTPTEPTTPKAPASPAERRKGERGEKQRKP   604
      ||||||||||||||||||||||||||||||||||||||||||||||||||
 401  CPSTRLLTLEEAQARTQGRLGTPTEPTTPKAPASPAERRKGERGEKQRKP   450

605  GGSSWKTFFALGRGPSVPRKKPLPWLGGTRAPPQPSGSRPDTVTLRSAKS   654
      ||||||||||||||||||||||||||||||||||||||||||||||||||
 451  GGSSWKTFFALGRGPSVPRKKPLPWLGGTRAPPQPSGSRPDTVTLRSAKS   500

655  EESLSSQASGAGLQRLHRLRRPHSSSDAFPVGPAPAGSCESLSSSSSSES   704
      ||||||||||||||||||||||||||||||||||||||||||||||||||
 501  EESLSSQASGAGLQRLHRLRRPHSSSDAFPVGPAPAGSCESLSSSSSSES   550

705  SSSESSSSSSESSAAGLGALSGSPSHRTSAWLDDGDELDFSPPRCLEGLR   754
      ||||||||||||||||||||||||||||||||||||||||||||||||||
 551  SSSESSSSSSESSAAGLGALSGSPSHRTSAWLDDGDELDFSPPRCLEGLR   600

755  GLDFDPLTFRCSSPTPGDPAPPASPAPPAPASAFPPRVTPQAISPRGPTS   804
      ||||||||||||||||||||||||||||||||||||||||||||||||||
 601  GLDFDPLTFRCSSPTPGDPAPPASPAPPAPASAFPPRVTPQAISPRGPTS   650

805  PASPAALDISEPLAVSVPPAVLELLGAGGAPASATPTPALSPGRSLRPHL   854
      ||||||||||||||||||||||||||||||||||||||||||||||||||
 651  PASPAALDISEPLAVSVPPAVLELLGAGGAPASATPTPALSPGRSLRPHL   700

855  IPLLLRGAEAPLTDACQQEMCSKLRGAQGPLGPDMESPLPPPPLSLLRPG   904
      ||||||||||||||||||||||||||||||||||||||||||||||||||
 701  IPLLLRGAEAPLTDACQQEMCSKLRGAQGPLGPDMESPLPPPPLSLLRPG   750

905  GAPPPPPKNPARLMALALAERAQQVAEQQSQQECGGTPPASQSPFHRSLS   954
      ||||||||||||||||||||||||||||||||||||||||||||||||||
 751  GAPPPPPKNPARLMALALAERAQQVAEQQSQQECGGTPPASQSPFHRSLS   800

955  LEVGGEPLGTSGSGPPPNSLAHPGAWVPGPPPYLPRQQSDGSLLRSQRPM   1004

801  GAPPPPPKNPARLMALALAERAQQVAEQQSQQECGGTPPASQSPFHRSLS   850

1005  GTSRRGLRGPAQVSAQLRAGGGGRDAPEAAAQSPCSVPSQVPTPGFFSPA   1054
      |||||||||||                              |||||||||
 851  GTSRRGLRGPA........................QVPTPGFFSPA     872

1055  PRECLPPFLGVPKPGLYPLGPPSFQPSSPAPVWRSSLGPPAPLDRGENLY   1104
      ||||||||||||||||||||||||||||||||||||||||||||||||||
 873  PRECLPPFLGVPKPGLYPLGPPSFQPSSPAPVWRSSLGPPAPLDRGENLY   922

1105  YEIGASEGSPYSGPTRSWSPFRSMPPDRLNASYGMLGQSPPLHRSPDFLL   1154
      ||||||||||||||||||||||||||||||||||||||||||||||||||
 923  YEIGASEGSPYSGPTRSWSPFRSMPPDRLNASYGMLGQSPPLHRSPDFLL   972

1155  SYPPAPSCFPPDHLGYSAP   1173
      ||||||||||||||||||.|
 973  SYPPAPSCFPPDHLGYSPP    991
```

Description for Cluster HUMCA1XIA

Cluster HUMCA1XIA features 4 transcript(s) and 46 segment(s) of interest, the names for which are given in Tables 828 and 829, respectively, the sequences themselves are given at the end of the application. The selected protein variants are given in table 830

TABLE 828

Transcripts of interest

| Transcript Name | Sequence ID No. |
|---|---|
| HUMCA1XIA_T16 | 99 |
| HUMCA1XIA_T17 | 100 |
| HUMCA1XIA_T19 | 101 |
| HUMCA1XIA_T20 | 102 |

TABLE 829

Segments of interest

| Segment Name | Sequence ID No. |
|---|---|
| HUMCA1XIA_node_0 | 742 |
| HUMCA1XIA_node_2 | 743 |
| HUMCA1XIA_node_4 | 744 |
| HUMCA1XIA_node_6 | 745 |
| HUMCA1XIA_node_8 | 746 |
| HUMCA1XIA_node_9 | 747 |
| HUMCA1XIA_node_18 | 748 |
| HUMCA1XIA_node_54 | 749 |
| HUMCA1XIA_node_55 | 750 |
| HUMCA1XIA_node_92 | 751 |
| HUMCA1XIA_node_11 | 752 |
| HUMCA1XIA_node_15 | 753 |
| HUMCA1XIA_node_19 | 754 |
| HUMCA1XIA_node_21 | 755 |
| HUMCA1XIA_node_23 | 756 |
| HUMCA1XIA_node_25 | 757 |
| HUMCA1XIA_node_27 | 758 |
| HUMCA1XIA_node_29 | 759 |
| HUMCA1XIA_node_31 | 760 |
| HUMCA1XIA_node_33 | 761 |
| HUMCA1XIA_node_35 | 762 |
| HUMCA1XIA_node_37 | 763 |
| HUMCA1XIA_node_39 | 764 |
| HUMCA1XIA_node_41 | 765 |
| HUMCA1XIA_node_43 | 766 |
| HUMCA1XIA_node_45 | 767 |
| HUMCA1XIA_node_47 | 769 |
| HUMCA1XIA_node_49 | 769 |
| HUMCA1XIA_node_51 | 770 |
| HUMCA1XIA_node_57 | 771 |
| HUMCA1XIA_node_59 | 772 |
| HUMCA1XIA_node_62 | 773 |
| HUMCA1XIA_node_64 | 774 |
| HUMCA1XIA_node_66 | 775 |
| HUMCA1XIA_node_68 | 776 |
| HUMCA1XIA_node_70 | 777 |
| HUMCA1XIA_node_72 | 778 |
| HUMCA1XIA_node_74 | 779 |
| HUMCA1XIA_node_76 | 780 |
| HUMCA1XIA_node_78 | 782 |
| HUMCA1XIA_node_81 | 783 |
| HUMCA1XIA_node_83 | 784 |
| HUMCA1XIA_node_85 | 785 |
| HUMCA1XIA_node_87 | 786 |
| HUMCA1XIA_node_89 | 787 |
| HUMCA1XIA_node_91 | 788 |

TABLE 830

Proteins of interest

| Protein Name | Sequence ID No. | Corresponding Transcript(s) |
|---|---|---|
| HUMCA1XIA_P14 | 1372 | HUMCA1XIA_T16 (SEQ ID NO: 99) |
| HUMCA1XIA_P15 | 1373 | HUMCA1XIA_T17 (SEQ ID NO: 100) |
| HUMCA1XIA_P16 | 1374 | HUMCA1XIA_T19 (SEQ ID NO: 101) |
| HUMCA1XIA_P17 | 1375 | HUMCA1XIA_T20 (SEQ ID NO: 102) |

These sequences are variants of the known protein Collagen alpha 1 (SwissProt accession identifier CA1B_HUMAN), SEQ ID NO: 1446, referred to herein as the previously known protein.

Protein Collagen alpha 1 (SEQ ID NO:1446) is known or believed to have the following function(s): May play an important role in fibrillogenesis by controlling lateral growth of collagen II fibrils. The sequence for protein Collagen alpha 1 is given at the end of the application, as "Collagen alpha 1 amino acid sequence". Known polymorphisms for this sequence are as shown in Table 831.

TABLE 831

Amino acid mutations for Known Protein

| SNP position(s) on amino acid sequence | Comment |
|---|---|
| 625 | G -> V (in STL2). /FTId = VAR_013583. |
| 676 | G -> R (in STL2; overlapping phenotype with Marshall syndrome). /FTId = VAR_013584. |
| 921-926 | Missing (in STL2; overlapping phenotype with Marshall syndrome). /FTId = VAR_013585. |
| 1313-1315 | Missing (in STL2; overlapping phenotype with Marshall syndrome). /FTId = VAR_013586. |
| 1516 | G -> V (in STL2; overlapping phenotype with Marshall syndrome). /FTId = VAR_013587. |
| 941-944 | KDGL -> RMGC |
| 986 | Y -> H |
| 1074 | R -> P |
| 1142 | G -> D |
| 1218 | M -> W |
| 1758 | T -> A |
| 1786 | S -> N |

The following GO Annotation(s) apply to the previously known protein. The following annotation(s) were found: cartilage condensation; vision; hearing; cell-cell adhesion; extracellular matrix organization and biogenesis, which are annotation(s) related to Biological Process; extracellular matrix structural protein; extracellular matrix protein, adhesive, which are annotation(s) related to Molecular Function; and extracellular matrix; collagen; collagen type XI, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

Cluster HUMCA1XIA can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 32 refer to weighted expression of ESTs in each category, as "parts per million" (ratio of the expression of ESTs for a particular cluster to the expression of all ESTs in that category, according to parts per million).

Figure 32:
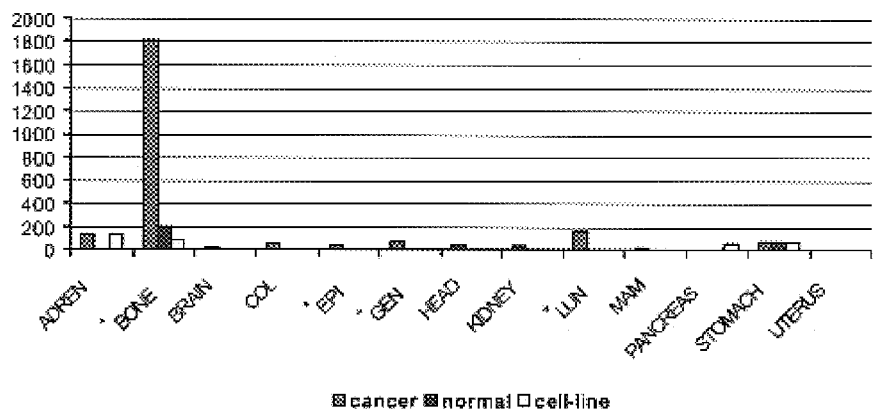
FIG. 32 is a histogram showing Cancer and cell-line vs. normal tissue expression for Cluster HUMCA1XIA, demonstrating overexpression in bone malignant tumors, epithelial malignant tumors, a mixture of malignant tumors from different tissues and lung malignant tumors.

Overall, the following results were obtained as shown with regard to the histograms in FIG. 32 and Table 832. This cluster is overexpressed (at least at a minimum level) in the following pathological conditions: bone malignant tumors, epithelial malignant tumors, a mixture of malignant tumors from different tissues and lung malignant tumors.

TABLE 832

Normal tissue distribution

| Name of Tissue | Number |
|---|---|
| adrenal | 0 |
| bone | 207 |
| brain | 13 |
| colon | 0 |
| epithelial | 11 |
| general | 11 |
| head and neck | 0 |
| kidney | 0 |
| lung | 0 |
| breast | 8 |
| pancreas | 0 |
| stomach | 73 |
| uterus | 9 |

TABLE 833

P values and ratios for expression in cancerous tissue

| Name of Tissue | P1 | P2 | SP1 | R3 | SP2 | R4 |
|---|---|---|---|---|---|---|
| adrenal | 4.2e–01 | 1.9e–01 | 9.6e–02 | 3.4 | 8.2e–02 | 3.6 |
| bone | 2.4e–01 | 6.3e–01 | 7.7e–10 | 4.3 | 5.3e–03 | 1.6 |
| brain | 5.0e–01 | 6.9e–01 | 1.8e–01 | 2.1 | 4.2e–01 | 1.3 |
| colon | 1.3e–02 | 2.9e–02 | 2.4e–01 | 3.0 | 3.5e–01 | 2.4 |
| epithelial | 3.9e–04 | 3.2e–03 | 1.3e–03 | 2.3 | 1.8e–02 | 1.7 |
| general | 5.6e–05 | 1.6e–03 | 9.5e–17 | 4.5 | 1.1e–09 | 2.8 |
| head and neck | 1.2e–01 | 2.1e–01 | 1 | 1.3 | 1 | 1.1 |
| kidney | 6.5e–01 | 7.2e–01 | 3.4e–01 | 2.4 | 4.9e–01 | 1.9 |
| lung | 5.3e–02 | 9.1e–02 | 5.5e–05 | 7.3 | 5.0e–03 | 4.0 |
| breast | 4.3e–01 | 5.6e–01 | 6.9e–01 | 1.4 | 8.2e–01 | 1.1 |
| pancreas | 3.3e–01 | 1.8e–01 | 4.2e–01 | 2.4 | 1.5e–01 | 3.7 |
| stomach | 5.0e–01 | 6.1e–01 | 6.9e–01 | 1.0 | 6.7e–01 | 0.8 |
| Uterus | 7.1e–01 | 7.0e–01 | 6.6e–01 | 1.1 | 6.4e–01 | 1.1 |

As noted above, cluster HUMCA1XIA features 4 transcript(s), which were listed in Table 1 above. These transcript(s) encode for protein(s) which are variant(s) of protein Collagen alpha 1 (SEQ ID NO:1446). A description of each variant protein according to the present invention is now provided.

Variant protein HUMCA1XIA_P14 (SEQ ID NO:1372) according to the present invention has an amino acid sequence as given at the end of the application; it is encoded by transcript(s) HUMCA1XIA_T16 (SEQ ID NO:99). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison Report Between HUMCA1XIA_P14 (SEQ ID NO:1372) and CA1B_HUMAN_V5 (SEQ ID NO:1447):

1. An isolated chimeric polypeptide encoding for HUMCA1XIA_P14 (SEQ ID NO:1372), comprising a first amino acid sequence being at least 90% homologous to MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEH YSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSED TLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPG RPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMP GEPGAKGDRGFDGLPGLPGDKGHRGERGPQGPPGPPGDDGMRGEDGEIGPRGLPGEAG PRGLLGPRGTPGAPGQPGMAGVDGPPGPKGNMGPQGEPGPPGQQGNPGPQGLPGPQG PIGPPGEKGPQGKPGLAGLPGADGPPGHPGKEGQSGEKGALGPPGPQGPIGYPGPRGVK GADGVRGLKGSKGEKGEDGFPGFKGDMGLKGDRGEVGQIGPRGEDGPEGPKGRAGPT GDPGPSGQAGEKGKLGVPGLPGYPGRQGPKGSTGFPGFPGANGEKGARGVAGKPGPR GQRGPTGPRGSRGARGPTGKPGPKGTSGGDGPPGPPGERGPQGPQGPVGFPGPKGPPGP PGKDGLPGHPGQRGETGFQGKTGPPGPGGVVGPQGPTGETGPIGERGHPGPPGPPGEQG LPGAAGKEGAKGDPGPQGISGKDGPAGLRGFPGERGLPGAQGAPGLKGGEGPQGPPGP V corresponding to amino acids 1-1056 of CA1B_HUMAN_V5 (SEQ ID NO:1447), which also corresponds to amino acids 1-1056 of HUMCA1XIA_P14 (SEQ ID NO:1372), and a second amino acid sequence being at least 70%, optionally at least 80%, preferably at least 85%, more preferably at least 90% and most preferably at least 95% homologous to a polypeptide having the sequence VSMMIINSQTIMVVNYSSSFITLML (SEQ ID NO: 256) corresponding to amino acids 1057-1081 of HUMCA1XIA_P14 (SEQ ID NO:1372), wherein said first amino acid sequence and second amino acid sequence are contiguous and in a sequential order.

2. An isolated polypeptide encoding for a tail of HUMCA1XIA_P14 (SEQ ID NO:1372), comprising a polypeptide being at least 70%, optionally at least about 80%, preferably at least about 85%, more preferably at least about 90% and most preferably at least about 95% homologous to the sequence VSMMIINSQTIMVVNYSSSFITLML (SEQ ID NO: 256) in HUMCA1XIA_P14 (SEQ ID NO:1372).

It should be noted that the known protein sequence (CA1B_HUMAN (SEQ ID NO:1446)) has one or more changes than the sequence given at the end of the application and named as being the amino acid sequence for CA1B_HUMAN_V5 (SEQ ID NO:1447). These changes were previously known to occur and are listed in the table below.

TABLE 834

Changes to CA1B_HUMAN_V5 (SEQ ID NO: 1447)

| SNP position(s) on amino acid sequence | Type of change |
|---|---|
| 987 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P14 (SEQ ID NO:1372) also has the following non-silent SNPs (Single Nucleotide Polymorphisms) as listed in Table 835, (given according to their position(s) on the amino acid sequence, with the alternative amino acid(s) listed; the last column indicates whether the SNP is known or not; the presence of known SNPs in variant protein HUMCA1XIA_P14 (SEQ ID NO:1372) sequence provides support for the deduced sequence of this variant protein according to the present invention).

TABLE 835

Amino acid mutations

| SNP position(s) on amino acid sequence | Alternative amino acid(s) | Previously known SNP? |
|---|---|---|
| 8 | W -> G | Yes |
| 46 | D -> E | Yes |
| 559 | G -> S | Yes |
| 832 | G -> * | Yes |
| 986 | H -> Y | Yes |
| 1061 | I -> M | Yes |
| 1070 | V -> A | Yes |

Variant protein HUMCA1XIA_P14 (SEQ ID NO:1372) is encoded by the following transcript(s): HUMCA1XIA_T16 (SEQ ID NO:99), for which the sequence(s) is/are given at the end of the application. The coding portion of transcript HUMCA1XIA_T16 (SEQ ID NO:99) is shown in bold; this coding portion starts at position 319 and ends at position 3561. The transcript also has the following SNPs as listed in Table 836 (given according to their position on the nucleotide sequence, with the alternative nucleic acid listed; the last column indicates whether the SNP is known or not; the presence of known SNPs in variant protein HUMCA1XIA_P14 (SEQ ID NO:1372) sequence provides support for the deduced sequence of this variant protein according to the present invention).

TABLE 836

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |

TABLE 836-continued

Nucleic acid SNPs

| SNP position on nucleotide sequence | Alternative nucleic acid | Previously known SNP? |
|---|---|---|
| 1993 | G -> A | Yes |
| 2812 | G -> T | Yes |
| 3274 | C -> T | Yes |
| 3282 | C -> T | Yes |
| 3501 | A -> G | Yes |
| 3527 | T -> C | Yes |

Variant protein HUMCA1XIA_P15 (SEQ ID NO:1373) according to the present invention has an amino acid sequence as given at the end of the application; it is encoded by transcript(s) HUMCA1XIA_T17 (SEQ ID NO:100). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison Report Between HUMCA1XIA_P15 (SEQ ID NO:1373) and CA1B_HUMAN (SEQ ID NO:1446):

1. An isolated chimeric polypeptide encoding for HUMCA1XIA_P15 (SEQ ID NO:1373), comprising a first amino acid sequence being at least 90% homologous to MEPWSSRWKTKRWLWDFTVTTLALT-FLFQAREVRGAAPVDVLKALDFHNSPEGISKTT GFCTNRKNSKGSDTAYRVSKQAQLSAPT-KQLFPGGTFPEDFSILFTVKPKKGIQSFLLSIY NEH-GIQQIGVEVGRSPVFLFEDHTGKPA-PEDYPLFRTVNIADGKWHRVAISVEKKTVTM IVDCKKKTTKPLDRSERAIVDTNGITVF-GTRILDEEVFEGDIQQFLITGDPKAAYDYCEH YSPD-CDSSAPKAAQAQEPQIDEYAPEDIIEY-DYEYGEAEYKEAESVTEGPTVTEETIAQT EANIVDDFQEYNYGTMESYQTEAPRHVS-GTNEPNPVEEIFTEEYLTGEDYDSQRKNSED TLYEN-KEIDGRDSDLLVDGDLGEYD-FYEYKEYEDKPTSPPNEEFGPGVPAETDITETSIN GHGAYGEKGQKGEPAVVEPGMLVEGPPG-PAGPAGIMGPPGLQGPTGPPGDPGDRGPPG RPGLP-GADGLPGPPGTMLMLPFRYGGDGSKGP-TISAQEAQAQAILQQARIALRGPPGPM GLTGRPGPVGGPGSSGAKGESGDPGPQG-PRGVQGPPGPTGKPGKRGRPGADGGRGMP GEP-GAKGDRGFDGLPGLPGDKGHRGERGPQG-PPGPPGDDGMRGEDGEIGPRGLPGEAG PRGLLGPRGTPGAPGQPGMAGVDGPPGP-KGNMGPQGEPGPPGQQGNPGPQGLPGPQG PIGP-PGEK corresponding to amino acids 1-714 of CA1B_HUMAN (SEQ ID NO:1446), which also corresponds to amino acids 1-714 of HUMCA1XIA_P15 (SEQ ID NO:1373), and a second amino acid sequence being at least 70%, optionally at least 80%, preferably at least 85%, more preferably at least 90% and most preferably at least 95% homologous to a polypeptide having the sequence MCCNLS-FGILIPLQK (SEQ ID NO: 257) corresponding to amino acids 715-729 of HUMCA1XIA_P15 (SEQ ID NO:1373), wherein said first amino acid sequence and second amino acid sequence are contiguous and in a sequential order.

2. An isolated polypeptide encoding for a tail of HUMCA1XIA_P15 (SEQ ID NO:1373), comprising a polypeptide being at least 70%, optionally at least about 80%, preferably at least about 85%, more preferably at least about 90% and most preferably at least about 95% homologous to the sequence MCCNLSFGILIPLQK (SEQ ID NO: 257) in HUMCA1XIA_P15 (SEQ ID NO:1373).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P15 (SEQ ID NO:1373) also has the following non-silent SNPs (Single Nucleotide Polymorphisms) as listed in Table 837, (given according to their position(s) on the amino acid sequence, with the alternative amino acid(s) listed; the last column indicates whether the SNP is known or not; the presence of known SNPs in variant protein HUMCA1XIA_P15 (SEQ ID NO:1373) sequence provides support for the deduced sequence of this variant protein according to the present invention).

TABLE 837

Amino acid mutations

| SNP position(s) on amino acid sequence | Alternative amino acid(s) | Previously known SNP? |
|---|---|---|
| 8 | W -> G | Yes |
| 46 | D -> E | Yes |
| 559 | G -> S | Yes |

The glycosylation sites of variant protein HUMCA1XIA_P15 (SEQ ID NO:1373), as compared to the known protein Collagen alpha 1 (SEQ ID NO:1446), are described in Table 838 (given according to their position(s) on the amino acid sequence in the first column; the second column indicates whether the glycosylation site is present in the variant protein; and the last column indicates whether the position is different on the variant protein).

TABLE 838

Glycosylation site(s)

| Position(s) on known amino acid sequence | Present in variant protein? |
|---|---|
| 1640 | no |

Variant protein HUMCA1XIA_P15 (SEQ ID NO:1373) is encoded by the following transcript(s): HUMCA1XIA_T17 (SEQ ID NO:100), for which the sequence(s) is/are given at the end of the application. The coding portion of transcript HUMCA1XIA_T17 (SEQ ID NO:100) is shown in bold; this coding portion starts at position 319 and ends at position 2505. The transcript also has the following SNPs as listed in Table 839 (given according to their position on the nucleotide sequence, with the alternative nucleic acid listed; the last column indicates whether the SNP is known or not; the presence of known SNPs in variant protein HUMCA1XIA_P15 (SEQ ID NO:1373) sequence provides support for the deduced sequence of this variant protein according to the present invention).

TABLE 839

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |
| 1993 | G -> A | Yes |
| 2473 | C -> T | Yes |

Variant protein HUMCA1XIA_P16 (SEQ ID NO:1374) according to the present invention has an amino acid sequence as given at the end of the application; it is encoded by transcript(s) HUMCA1XIA_T19 (SEQ ID NO:101). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison Report Between HUMCA1XIA_P16 (SEQ ID NO:1374) and CA1B_HUMAN (SEQ ID NO:1446):

1. An isolated chimeric polypeptide encoding for HUMCA1XIA_P16 (SEQ ID NO:1374), comprising a first amino acid sequence being at least 90% homologous to MEPWSSRWKTKRWLWDFTVTTLALT-FLFQAREVRGAAPVDVLKALDFHNSPEGISKTT GFCTNRKNSKGSDTAYRVSKQAQLSAPT-KQLFPGGTFPEDFSILFTVKPKKGIQSFLLSIY NEH-GIQQIGVEVGRSPVFLFEDHTGKPA-PEDYPLFRTVNIADGKWHRVAISVEKKTVTM IVDCKKKTTKPLDRSERAIVDTNGITVF-GTRILDEEVFEGDIQQFLITGDPKAAYDYCEH YSPD-CDSSAPKAAQAQEPQIDEYAPEDIIEY-DYEYGEAEYKEAESVTEGPTVTEETIAQT EANIVDDFQEYNYGTMESYQTEAPRHVS-GTNEPNPVEEIFTEEYLTGEDYDSQRKNSED TLYEN-KEIDGRDSDLLVDGDLGEYD-FYEYKEYEDKPTSPPNEEFGPGVPAETDITETSIN GHGAYGEKGQKGEPAVVEPGMLVEGPPG-PAGPAGIMGPPGLQGPTGPPGDPGDRGPPG RPGLP-GADGLPGPPGTMLMLPFRYGGDGSKGP-TISAQEAQAQAILQQARIALRGPPGPM GLTGRPGPVGGPGSSGAKGESGDPGPQG-PRGVQGPPGPTGKPGKRGRPGADGGRGMP GEP-GAKGDRGFDGLPGLPGDKGHRGERGPQG-PPGPPGDDGMRGEDGEIGPRGLPGEA corresponding to amino acids 1-648 of CA1B_HUMAN (SEQ ID NO:1446), which also corresponds to amino acids 1-648 of HUMCA1XIA_P16 (SEQ ID NO:1374), a second amino acid sequence being at least 90% homologous to GMAGVDGPPGPKGNMGPQGEPGP-PGQQGNPGPQGLPGPQGPIGPPGEK corresponding to amino acids 667-714 of CA1B_HUMAN (SEQ ID NO:1446), which also corresponds to amino acids 649-696 of HUMCA1XIA_P16 (SEQ ID NO:1374), and a third amino acid sequence being at least 70%, optionally at least 80%, preferably at least 85%, more preferably at least 90% and most preferably at least 95% homologous to a polypeptide having the sequence VSFSFSLFYKKVIKFACD-KRFVGRHDERKVVKLSLPLYLIYE (SEQ ID NO: 258) corresponding to amino acids 697-738 of HUMCA1XIA_P16 (SEQ ID NO:1374), wherein said first amino acid sequence, second amino acid sequence and third amino acid sequence are contiguous and in a sequential order.

2. An isolated chimeric polypeptide encoding for an edge portion of HUMCA1XIA_P16 (SEQ ID NO:1374), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AG, having a structure as follows: a sequence starting from any of amino acid numbers 648–x to 648; and ending at any of amino acid numbers 649+((n−2)−x), in which x varies from 0 to n−2.

3. An isolated polypeptide encoding for a tail of HUMCA1XIA_P16 (SEQ ID NO:1374), comprising a polypeptide being at least 70%, optionally at least about 80%, preferably at least about 85%, more preferably at least about 90% and most preferably at least about 95% homologous to the sequence VSFSFSLFYKKVIKFACDKRFVGRHDERKVVKLSLPLYLIYE (SEQ ID NO: 258) in HUMCA1XIA_P16 (SEQ ID NO:1374).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P16 (SEQ ID NO:1374) also has the following non-silent SNPs (Single Nucleotide Polymorphisms) as listed in Table 840, (given according to their position(s) on the amino acid sequence, with the alternative amino acid(s) listed; the last column indicates whether the SNP is known or not; the presence of known SNPs in variant protein HUMCA1XIA_P16 (SEQ ID NO:1374) sequence provides support for the deduced sequence of this variant protein according to the present invention).

TABLE 840

Amino acid mutations

| SNP position(s) on amino acid sequence | Alternative amino acid(s) | Previously known SNP? |
|---|---|---|
| 8 | W -> G | Yes |
| 46 | D -> E | Yes |
| 559 | G -> S | Yes |

The glycosylation sites of variant protein HUMCA1XIA_P16 (SEQ ID NO:1374), as compared to the known protein Collagen alpha 1 (SEQ ID NO:1446), are described in Table 841 (given according to their position(s) on the amino acid sequence in the first column; the second column indicates whether the glycosylation site is present in the variant protein; and the last column indicates whether the position is different on the variant protein).

TABLE 841

Glycosylation site(s)

| Position(s) on known amino acid sequence | Present in variant protein? |
|---|---|
| 1640 | no |

Variant protein HUMCA1XIA_P16 (SEQ ID NO:1374) is encoded by the following transcript(s): HUMCA1XIA_T19 (SEQ ID NO:101), for which the sequence(s) is/are given at the end of the application. The coding portion of transcript HUMCA1XIA_T19 (SEQ ID NO:101) is shown in bold; this coding portion starts at position 319 and ends at position 2532. The transcript also has the following SNPs as listed in Table 842 (given according to their position on the nucleotide sequence, with the alternative nucleic acid listed; the last column indicates whether the SNP is known or not; the presence of known SNPs in variant protein HUMCA1XIA_P16 (SEQ ID NO:1374) sequence provides support for the deduced sequence of this variant protein according to the present invention).

TABLE 842

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |
| 1993 | G -> A | Yes |
| 2606 | C -> A | Yes |
| 2677 | T -> G | Yes |
| 2849 | C -> T | Yes |

Variant protein HUMCA1XIA_P17 (SEQ ID NO:1375) according to the present invention has an amino acid sequence as given at the end of the application; it is encoded by transcript(s) HUMCA1XIA_T20 (SEQ ID NO:102). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison Report Between HUMCA1XIA_P17 (SEQ ID NO:1375) and CA1B_HUMAN (SEQ ID NO:1446):

1. An isolated chimeric polypeptide encoding for HUMCA1XIA_P17 (SEQ ID NO:1375), comprising a first amino acid sequence being at least 90% homologous to MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIY NEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEH YSPDCDSSAPKAAQAQEPQIDE corresponding to amino acids 1-260 of CA1B_HUMAN (SEQ ID NO:1446), which also corresponds to amino acids 1-260 of HUMCA1XIA_P17 (SEQ ID NO:1375), and a second amino acid sequence being at least 70%, optionally at least 80%, preferably at least 85%, more preferably at least 90% and most preferably at least 95% homologous to a polypeptide having the sequence VRSTR-PEKVFVFQ (SEQ ID NO: 259) corresponding to amino acids 261-273 of HUMCA1XIA_P17 (SEQ ID NO:1375), wherein said first amino acid sequence and second amino acid sequence are contiguous and in a sequential order.

2. An isolated polypeptide encoding for a tail of HUMCA1XIA_P17 (SEQ ID NO:1375), comprising a polypeptide being at least 70%, optionally at least about 80%, preferably at least about 85%, more preferably at least about 90% and most preferably at least about 95% homologous to the sequence VRSTRPEKVFVFQ (SEQ ID NO: 259) in HUMCA1XIA_P17 (SEQ ID NO:1375).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P17 (SEQ ID NO:1375) also has the following non-silent SNPs (Single Nucleotide Polymorphisms) as listed in Table 843, (given according to their position(s) on the amino acid sequence, with the alternative amino acid(s) listed; the last column indicates whether the SNP is known or not; the presence of known SNPs in variant protein HUMCA1XIA_P17 (SEQ ID NO:1375) sequence provides support for the deduced sequence of this variant protein according to the present invention).

TABLE 843

Amino acid mutations

| SNP position(s) on amino acid sequence | Alternative amino acid(s) | Previously known SNP? |
|---|---|---|
| 8 | W -> G | Yes |
| 46 | D -> E | Yes |

The glycosylation sites of variant protein HUMCA1XIA_P17 (SEQ ID NO:1375), as compared to the known protein Collagen alpha 1 (SEQ ID NO:1446), are described in Table 844 (given according to their position(s) on the amino acid sequence in the first column; the second column indicates whether the glycosylation site is present in the variant protein; and the last column indicates whether the position is different on the variant protein).

TABLE 844

Glycosylation site(s)

| Position(s) on known amino acid sequence | Present in variant protein? |
|---|---|
| 1640 | no |

Variant protein HUMCA1XIA_P17 (SEQ ID NO:1375) is encoded by the following transcript(s): HUMCA1 XIA_T20 (SEQ ID NO:102), for which the sequence(s) is/are given at the end of the application. The coding portion of transcript HUMCA1XIA_T20 (SEQ ID NO:102) is shown in bold; this coding portion starts at position 319 and ends at position 1137. The transcript also has the following SNPs as listed in Table 845 (given according to their position on the nucleotide sequence, with the alternative nucleic acid listed; the last column indicates whether the SNP is known or not; the presence of known SNPs in variant protein HUMCA1XIA_P17 (SEQ ID NO:1375) sequence provides support for the deduced sequence of this variant protein according to the present invention).

TABLE 845

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |
| 1150 | A -> C | Yes |

As noted above, cluster HUMCA1XIA features 46 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMCA1XIA_node_0 (SEQ ID NO:742) according to the present invention is supported by 13 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 846 below describes the starting and ending position of this segment on each transcript.

TABLE 846

Segment location on transcripts

| Transcript name | Segment starting position | Segment ending position |
|---|---|---|
| HUMCA1XIA_T16 (SEQ ID NO: 99) | 1 | 424 |
| HUMCA1XIA_T17 (SEQ ID NO: 100) | 1 | 424 |
| HUMCA1XIA_T19 (SEQ ID NO: 101) | 1 | 424 |
| HUMCA1XIA_T20 (SEQ ID NO: 102) | 1 | 424 |

Segment cluster HUMCA1XIA_node_2 (SEQ ID NO:743) according to the present invention is supported by 9 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 847 below describes the starting and ending position of this segment on each transcript.

TABLE 847

Segment location on transcripts

| Transcript name | Segment starting position | Segment ending position |
|---|---|---|
| HUMCA1XIA_T16 (SEQ ID NO: 99) | 425 | 592 |
| HUMCA1XIA_T17 (SEQ ID NO: 100) | 425 | 592 |

TABLE 847-continued

Segment location on transcripts

| Transcript name | Segment starting position | Segment ending position |
|---|---|---|
| HUMCA1XIA_T19 (SEQ ID NO: 101) | 425 | 592 |
| HUMCA1XIA_T20 (SEQ ID NO: 102) | 425 | 592 |

Segment cluster HUMCA1XIA_node_4 (SEQ ID NO:744) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 848 below describes the starting and ending position of this segment on each transcript.

TABLE 848

Segment location on transcripts

| Transcript name | Segment starting position | Segment ending position |
|---|---|---|
| HUMCA1XIA_T16 (SEQ ID NO: 99) | 593 | 806 |
| HUMCA1XIA_T17 (SEQ ID NO: 100) | 593 | 806 |
| HUMCA1XIA_T19 (SEQ ID NO: 101) | 593 | 806 |
| HUMCA1XIA_T20 (SEQ ID NO: 102) | 593 | 806 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 849.

TABLE 849

Oligonucleotides related to this segment

| Oligonucleotide name | Overexpressed in cancers | Chip reference |
|---|---|---|
| HUMCA1XIA_0_18_0 | lung malignant tumors | LUN |

Segment cluster HUMCA1XIA_node_6 (SEQ ID NO:745) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 850 below describes the starting and ending position of this segment on each transcript.

TABLE 850

Segment location on transcripts

| Transcript name | Segment starting position | Segment ending position |
|---|---|---|
| HUMCA1XIA_T16 (SEQ ID NO: 99) | 807 | 969 |
| HUMCA1XIA_T17 (SEQ ID NO: 100) | 807 | 969 |

TABLE 850-continued

Segment location on transcripts

| Transcript name | Segment starting position | Segment ending position |
|---|---|---|
| HUMCA1XIA_T19 (SEQ ID NO: 101) | 807 | 969 |
| HUMCA1XIA_T20 (SEQ ID NO: 102) | 807 | 969 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 851.

TABLE 851

Oligonucleotides related to this segment

| Oligonucleotide name | Overexpressed in cancers | Chip reference |
|---|---|---|
| HUMCA1XIA_0_18_0 | lung malignant tumors | LUN |

Segment cluster HUMCA1XIA_node_8 (SEQ ID NO:746) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 852 below describes the starting and ending position of this segment on each transcript.

TABLE 852

Segment location on transcripts

| Transcript name | Segment starting position | Segment ending position |
|---|---|---|
| HUMCA1XIA_T16 (SEQ ID NO: 99) | 970 | 1098 |
| HUMCA1XIA_T17 (SEQ ID NO: 100) | 970 | 1098 |
| HUMCA1XIA_T19 (SEQ ID NO: 101) | 970 | 1098 |
| HUMCA1XIA_T20 (SEQ ID NO: 102) | 970 | 1098 |

Segment cluster HUMCA1XIA_node_9 (SEQ ID NO:747) according to the present invention is supported by 2 libraries. The number of libraries was determined as previously described. This segment can be found in the following transcript(s): HUMCA1XIA_T20 (SEQ ID NO:102). Table 853 below describes the starting and ending position of this segment on each transcript.

TABLE 853

Segment location on transcripts

| Transcript name | Segment starting position | Segment ending position |
|---|---|---|
| HUMCA1XIA_T20 (SEQ ID NO: 102) | 1099 | 1271 |

Segment cluster HUMCA1XIA_node_18 (SEQ ID NO:748) according to the present invention is supported by 6 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 854 below describes the starting and ending position of this segment on each transcript.

TABLE 854

Segment location on transcripts

| Transcript name | Segment starting position | Segment ending position |
|---|---|---|
| HUMCA1XIA_T16 (SEQ ID NO: 99) | 1309 | 1522 |
| HUMCA1XIA_T17 (SEQ ID NO: 100) | 1309 | 1522 |
| HUMCA1XIA_T19 (SEQ ID NO: 101) | 1309 | 1522 |

Segment cluster HUMCA1XIA_node_54 (SEQ ID NO:749) according to the present invention is supported by 2 libraries. The number of libraries was determined as previously described. This segment can be found in the following transcript(s): HUMCA1XIA_T19 (SEQ ID NO:101). Table 855 below describes the starting and ending position of this segment on each transcript.

TABLE 855

Segment location on transcripts

| Transcript name | Segment starting position | Segment ending position |
|---|---|---|
| HUMCA1XIA_T19 (SEQ ID NO: 101) | 2407 | 2836 |

Segment cluster HUMCA1XIA_node_55 (SEQ ID NO:750) according to the present invention is supported by 4 libraries. The number of libraries was determined as previously described. This segment can be found in the following transcript(s): HUMCA1XIA_T17 (SEQ ID NO:100) and HUMCA1XIA_T19 (SEQ ID NO:101). Table 856 below describes the starting and ending position of this segment on each transcript.

TABLE 856

Segment location on transcripts

| Transcript name | Segment starting position | Segment ending position |
|---|---|---|
| HUMCA1XIA_T17 (SEQ ID NO: 100) | 2461 | 2648 |
| HUMCA1XIA_T19 (SEQ ID NO: 101) | 2837 | 3475 |

Segment cluster HUMCA1XIA_node_92 (SEQ ID NO:751) according to the present invention is supported by 2 libraries. The number of libraries was determined as previously described. This segment can be found in the following transcript(s): HUMCA1XIA_T16 (SEQ ID NO:99). Table 857 below describes the starting and ending position of this segment on each transcript.

TABLE 857

Segment location on transcripts

| Transcript name | Segment starting position | Segment ending position |
|---|---|---|
| HUMCA1XIA_T16 (SEQ ID NO: 99) | 3487 | 3615 |

According to an optional embodiment of the present invention, short segments related to the above cluster are also provided. These segments are up to about 120 bp in length, and so are included in a separate description.

Segment cluster HUMCA1XIA_node_11 (SEQ ID NO:752) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 858 below describes the starting and ending position of this segment on each transcript.

TABLE 858

Segment location on transcripts

| Transcript name | Segment starting position | Segment ending position |
|---|---|---|
| HUMCA1XIA_T16 (SEQ ID NO: 99) | 1099 | 1215 |
| HUMCA1XIA_T17 (SEQ ID NO: 100) | 1099 | 1215 |
| HUMCA1XIA_T19 (SEQ ID NO: 101) | 1099 | 1215 |

Segment cluster HUMCA1XIA_node_15 (SEQ ID NO:753) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 859 below describes the starting and ending position of this segment on each transcript.

TABLE 859

Segment location on transcripts

| Transcript name | Segment starting position | Segment ending position |
|---|---|---|
| HUMCA1XIA_T16 (SEQ ID NO: 99) | 1216 | 1308 |
| HUMCA1XIA_T17 (SEQ ID NO: 100) | 1216 | 1308 |
| HUMCA1XIA_T19 (SEQ ID NO: 101) | 1216 | 1308 |

Segment cluster HUMCA1XIA_node_19 (SEQ ID NO:754) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 860 below describes the starting and ending position of this segment on each transcript.

TABLE 860

Segment location on transcripts

| Transcript name | Segment starting position | Segment ending position |
|---|---|---|
| HUMCA1XIA_T16 (SEQ ID NO: 99) | 1523 | 1563 |
| HUMCA1XIA_T17 (SEQ ID NO: 100) | 1523 | 1563 |
| HUMCA1XIA_T19 (SEQ ID NO: 101) | 1523 | 1563 |

Segment cluster HUMCA1XIA_node_21 (SEQ ID NO:755) according to the present invention is supported by 2 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 861 below describes the starting and ending position of this segment on each transcript.

TABLE 861

Segment location on transcripts

| Transcript name | Segment starting position | Segment ending position |
|---|---|---|
| HUMCA1XIA_T16 (SEQ ID NO: 99) | 1564 | 1626 |
| HUMCA1XIA_T17 (SEQ ID NO: 100) | 1564 | 1626 |
| HUMCA1XIA_T19 (SEQ ID NO: 101) | 1564 | 1626 |

Segment cluster HUMCA1XIA_node_23 (SEQ ID NO:756) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 862 below describes the starting and ending position of this segment on each transcript.

TABLE 862

Segment location on transcripts

| Transcript name | Segment starting position | Segment ending position |
|---|---|---|
| HUMCA1XIA_T16 (SEQ ID NO: 99) | 1627 | 1668 |
| HUMCA1XIA_T17 (SEQ ID NO: 100) | 1627 | 1668 |
| HUMCA1XIA_T19 (SEQ ID NO: 101) | 1627 | 1668 |

Segment cluster HUMCA1XIA_node_25 (SEQ ID NO:757) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 863 below describes the starting and ending position of this segment on each transcript.

TABLE 863

Segment location on transcripts

| Transcript name | Segment starting position | Segment ending position |
|---|---|---|
| HUMCA1XIA_T16 (SEQ ID NO: 99) | 1669 | 1731 |
| HUMCA1XIA_T17 (SEQ ID NO: 100) | 1669 | 1731 |
| HUMCA1XIA_T19 (SEQ ID NO: 101) | 1669 | 1731 |

Segment cluster HUMCA1XIA_node_27 (SEQ ID NO:758) according to the present invention is supported by 2 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 864 below describes the starting and ending position of this segment on each transcript.

TABLE 864

Segment location on transcripts

| Transcript name | Segment starting position | Segment ending position |
|---|---|---|
| HUMCA1XIA_T16 (SEQ ID NO: 99) | 1732 | 1806 |
| HUMCA1XIA_T17 (SEQ ID NO: 100) | 1732 | 1806 |
| HUMCA1XIA_T19 (SEQ ID NO: 101) | 1732 | 1806 |

Segment cluster HUMCA1XIA_node_29 (SEQ ID NO:759) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 865 below describes the starting and ending position of this segment on each transcript.

TABLE 865

Segment location on transcripts

| Transcript name | Segment starting position | Segment ending position |
|---|---|---|
| HUMCA1XIA_T16 (SEQ ID NO: 99) | 1807 | 1890 |
| HUMCA1XIA_T17 (SEQ ID NO: 100) | 1807 | 1890 |
| HUMCA1XIA_T19 (SEQ ID NO: 101) | 1807 | 1890 |

Segment cluster HUMCA1XIA_node_31 (SEQ ID NO:760) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 866 below describes the starting and ending position of this segment on each transcript.

TABLE 866

Segment location on transcripts

| Transcript name | Segment starting position | Segment ending position |
|---|---|---|
| HUMCA1XIA_T16 (SEQ ID NO: 99) | 1891 | 1947 |
| HUMCA1XIA_T17 (SEQ ID NO: 100) | 1891 | 1947 |
| HUMCA1XIA_T19 (SEQ ID NO: 101) | 1891 | 1947 |

Segment cluster HUMCA1XIA_node_33 (SEQ ID NO:761) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T9 (SEQ ID NO:101). Table 867 below describes the starting and ending position of this segment on each transcript.

TABLE 867

Segment location on transcripts

| Transcript name | Segment starting position | Segment ending position |
|---|---|---|
| HUMCA1XIA_T16 (SEQ ID NO: 99) | 1948 | 2001 |
| HUMCA1XIA_T17 (SEQ ID NO: 100) | 1948 | 2001 |
| HUMCA1XIA_T19 (SEQ ID NO: 101) | 1948 | 2001 |

Segment cluster HUMCA1XIA_node_35 (SEQ ID NO:762) according to the present invention is supported by 4 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 868 below describes the starting and ending position of this segment on each transcript.

TABLE 868

Segment location on transcripts

| Transcript name | Segment starting position | Segment ending position |
|---|---|---|
| HUMCA1XIA_T16 (SEQ ID NO: 99) | 2002 | 2055 |
| HUMCA1XIA_T17 (SEQ ID NO: 100) | 2002 | 2055 |
| HUMCA1XIA_T19 (SEQ ID NO: 101) | 2002 | 2055 |

Segment cluster HUMCA1XIA_node_37 (SEQ ID NO:763) according to the present invention is supported by 4 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 869 below describes the starting and ending position of this segment on each transcript.

TABLE 869

Segment location on transcripts

| Transcript name | Segment starting position | Segment ending position |
|---|---|---|
| HUMCA1XIA_T16 (SEQ ID NO: 99) | 2056 | 2109 |
| HUMCA1XIA_T17 (SEQ ID NO: 100) | 2056 | 2109 |
| HUMCA1XIA_T19 (SEQ ID NO: 101) | 2056 | 2109 |

Segment cluster HUMCA1XIA_node_39 (SEQ ID NO:764) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 870 below describes the starting and ending position of this segment on each transcript.

TABLE 870

Segment location on transcripts

| Transcript name | Segment starting position | Segment ending position |
|---|---|---|
| HUMCA1XIA_T16 (SEQ ID NO: 99) | 2110 | 2163 |
| HUMCA1XIA_T17 (SEQ ID NO: 100) | 2110 | 2163 |
| HUMCA1XIA_T19 (SEQ ID NO: 101) | 2110 | 2163 |

Segment cluster HUMCA1XIA_node_41 (SEQ ID NO:765) according to the present invention is supported by 4 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 871 below describes the starting and ending position of this segment on each transcript.

TABLE 871

Segment location on transcripts

| Transcript name | Segment starting position | Segment ending position |
|---|---|---|
| HUMCA1XIA_T16 (SEQ ID NO: 99) | 2164 | 2217 |
| HUMCA1XIA_T17 (SEQ ID NO: 100) | 2164 | 2217 |
| HUMCA1XIA_T19 (SEQ ID NO: 101) | 2164 | 2217 |

Segment cluster HUMCA1XIA_node_43 (SEQ ID NO:766) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 872 below describes the starting and ending position of this segment on each transcript.

TABLE 872

Segment location on transcripts

| Transcript name | Segment starting position | Segment ending position |
|---|---|---|
| HUMCA1XIA_T16 (SEQ ID NO: 99) | 2218 | 2262 |
| HUMCA1XIA_T17 (SEQ ID NO: 100) | 2218 | 2262 |
| HUMCA1XIA_T19 (SEQ ID NO: 101) | 2218 | 2262 |

Segment cluster HUMCA1XIA_node_45 (SEQ ID NO:767) according to the present invention is supported by 4 libraries. The number of libraries was determined as previously described. This segment can be found in the following transcript(s): HUMCA1XIA_T16 (SEQ ID NO:99) and HUMCA1XIA_T17 (SEQ ID NO:100). Table 873 below describes the starting and ending position of this segment on each transcript.

TABLE 873

Segment location on transcripts

| Transcript name | Segment starting position | Segment ending position |
|---|---|---|
| HUMCA1XIA_T16 (SEQ ID NO: 99) | 2263 | 2316 |
| HUMCA1XIA_T17 (SEQ ID NO: 100) | 2263 | 2316 |

Segment cluster HUMCA1XIA_node_47 (SEQ ID NO:768) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 874 below describes the starting and ending position of this segment on each transcript.

TABLE 874

Segment location on transcripts

| Transcript name | Segment starting position | Segment ending position |
|---|---|---|
| HUMCA1XIA_T16 (SEQ ID NO: 99) | 2317 | 2361 |
| HUMCA1XIA_T17 (SEQ ID NO: 100) | 2317 | 2361 |
| HUMCA1XIA_T19 (SEQ ID NO: 101) | 2263 | 2307 |

Segment cluster HUMCA1XIA_node_49 (SEQ ID NO:769) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 875 below describes the starting and ending position of this segment on each transcript.

TABLE 875

Segment location on transcripts

| Transcript name | Segment starting position | Segment ending position |
|---|---|---|
| HUMCA1XIA_T16 (SEQ ID NO: 99) | 2362 | 2415 |
| HUMCA1XIA_T17 (SEQ ID NO: 100) | 2362 | 2415 |
| HUMCA1XIA_T19 (SEQ ID NO: 101) | 2308 | 2361 |

Segment cluster HUMCA1XIA_node_51 (SEQ ID NO:770) according to the present invention is supported by 7 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 876 below describes the starting and ending position of this segment on each transcript.

TABLE 876

Segment location on transcripts

| Transcript name | Segment starting position | Segment ending position |
|---|---|---|
| HUMCA1XIA_T16 (SEQ ID NO: 99) | 2416 | 2460 |
| HUMCA1XIA_T17 (SEQ ID NO: 100) | 2416 | 2460 |
| HUMCA1XIA_T19 (SEQ ID NO: 101) | 2362 | 2406 |

Segment cluster HUMCA1XIA_node_57 (SEQ ID NO:771) according to the present invention is supported by 4 libraries. The number of libraries was determined as previously described. This segment can be found in the following transcript(s): HUMCA1XIA_T16 (SEQ ID NO:99). Table 877 below describes the starting and ending position of this segment on each transcript.

TABLE 877

Segment location on transcripts

| Transcript name | Segment starting position | Segment ending position |
|---|---|---|
| HUMCA1XIA_T16 (SEQ ID NO: 99) | 2461 | 2514 |

Segment cluster HUMCA1XIA_node_59 (SEQ ID NO:772) according to the present invention is supported by 3 libraries. The number of libraries was determined as previously described. This segment can be found in the following transcript(s): HUMCA1XIA_T16 (SEQ ID NO:99). Table 878 below describes the starting and ending position of this segment on each transcript.

TABLE 878

Segment location on transcripts

| Transcript name | Segment starting position | Segment ending position |
|---|---|---|
| HUMCA1XIA_T16 (SEQ ID NO: 99) | 2515 | 2559 |

Segment cluster HUMCA1XIA_node_62 (SEQ ID NO:773) according to the present invention is supported by 3 libraries. The number of libraries was determined as previously described. This segment can be found in the following transcript(s): HUMCA1XIA_T16 (SEQ ID NO:99). Table 879 below describes the starting and ending position of this segment on each transcript.

TABLE 879

Segment location on transcripts

| Transcript name | Segment starting position | Segment ending position |
|---|---|---|
| HUMCA1XIA_T16 (SEQ ID NO: 99) | 2560 | 2613 |

Segment cluster HUMCA1XIA_node_64 (SEQ ID NO:774) according to the present invention is supported by 4 libraries. The number of libraries was determined as previously described. This segment can be found in the following transcript(s): HUMCA1XIA_T16 (SEQ ID NO:99). Table 880 below describes the starting and ending position of this segment on each transcript.

TABLE 880

Segment location on transcripts

| Transcript name | Segment starting position | Segment ending position |
|---|---|---|
| HUMCA1XIA_T16 (SEQ ID NO: 99) | 2614 | 2658 |

Segment cluster HUMCA1XIA_node_66 (SEQ ID NO:775) according to the present invention is supported by 4 libraries. The number of libraries was determined as previously described. This segment can be found in the following transcript(s): HUMCA1XIA_T16 (SEQ ID NO:99). Table 881 below describes the starting and ending position of this segment on each transcript.

TABLE 881

Segment location on transcripts

| Transcript name | Segment starting position | Segment ending position |
|---|---|---|
| HUMCA1XIA_T16 (SEQ ID NO: 99) | 2659 | 2712 |

Segment cluster HUMCA1XIA_node_68 (SEQ ID NO:776) according to the present invention is supported by 7 libraries. The number of libraries was determined as previously described. This segment can be found in the following transcript(s): HUMCA1XIA_T16 (SEQ ID NO:99). Table 882 below describes the starting and ending position of this segment on each transcript.

TABLE 882

Segment location on transcripts

| Transcript name | Segment starting position | Segment ending position |
|---|---|---|
| HUMCA1XIA_T16 (SEQ ID NO: 99) | 2713 | 2820 |

Segment cluster HUMCA1XIA_node_70 (SEQ ID NO:777) according to the present invention is supported by 6 libraries. The number of libraries was determined as previously described. This segment can be found in the following transcript(s): HUMCA1XIA_T16 (SEQ ID NO:99). Table 883 below describes the starting and ending position of this segment on each transcript.

TABLE 883

Segment location on transcripts

| Transcript name | Segment starting position | Segment ending position |
|---|---|---|
| HUMCA1XIA_T16 (SEQ ID NO: 99) | 2821 | 2874 |

Segment cluster HUMCA1XIA_node_72 (SEQ ID NO:778) according to the present invention is supported by 6 libraries. The number of libraries was determined as previously described. This segment can be found in the following transcript(s): HUMCA1XIA_T16 (SEQ ID NO:99). Table 884 below describes the starting and ending position of this segment on each transcript.

TABLE 884

Segment location on transcripts

| Transcript name | Segment starting position | Segment ending position |
|---|---|---|
| HUMCA1XIA_T16 (SEQ ID NO: 99) | 2875 | 2928 |

Segment cluster HUMCA1XIA_node_74 (SEQ ID NO:779) according to the present invention is supported by 5 libraries. The number of libraries was determined as previously described. This segment can be found in the following transcript(s): HUMCA1XIA_T16 (SEQ ID NO:99). Table 885 below describes the starting and ending position of this segment on each transcript.

TABLE 885

Segment location on transcripts

| Transcript name | Segment starting position | Segment ending position |
|---|---|---|
| HUMCA1XIA_T16 (SEQ ID NO: 99) | 2929 | 2973 |

Segment cluster HUMCA1XIA_node_76 (SEQ ID NO:780) according to the present invention is supported by 6 libraries. The number of libraries was determined as previously described. This segment can be found in the following transcript(s): HUMCA1XIA_T16 (SEQ ID NO:99). Table 886 below describes the starting and ending position of this segment on each transcript.

TABLE 886

Segment location on transcripts

| Transcript name | Segment starting position | Segment ending position |
|---|---|---|
| HUMCA1XIA_T16 (SEQ ID NO: 99) | 2974 | 3027 |

Segment cluster HUMCA1XIA_node_78 (SEQ ID NO:782) according to the present invention is supported by 6 libraries. The number of libraries was determined as previously described. This segment can be found in the following transcript(s): HUMCA1XIA_T16 (SEQ ID NO:99). Table 887 below describes the starting and ending position of this segment on each transcript.

TABLE 887

Segment location on transcripts

| Transcript name | Segment starting position | Segment ending position |
|---|---|---|
| HUMCA1XIA_T16 (SEQ ID NO: 99) | 3028 | 3072 |

Segment cluster HUMCA1XIA_node_81 (SEQ ID NO:783) according to the present invention is supported by 8 libraries. The number of libraries was determined as previously described. This segment can be found in the following transcript(s): HUMCA1XIA_T16 (SEQ ID NO:99). Table 888 below describes the starting and ending position of this segment on each transcript.

TABLE 888

Segment location on transcripts

| Transcript name | Segment starting position | Segment ending position |
|---|---|---|
| HUMCA1XIA_T16 (SEQ ID NO: 99) | 3073 | 3126 |

Segment cluster HUMCA1XIA_node_83 (SEQ ID NO:784) according to the present invention is supported by 7 libraries. The number of libraries was determined as previously described. This segment can be found in the following transcript(s): HUMCA1XIA_T16 (SEQ ID NO:99). Table 889 below describes the starting and ending position of this segment on each transcript.

TABLE 889

Segment location on transcripts

| Transcript name | Segment starting position | Segment ending position |
|---|---|---|
| HUMCA1XIA_T16 (SEQ ID NO: 99) | 3127 | 3180 |

Segment cluster HUMCA1XIA_node_85 (SEQ ID NO:785) according to the present invention is supported by 6 libraries. The number of libraries was determined as previously described. This segment can be found in the following transcript(s): HUMCA1XIA_T16 (SEQ ID NO:99). Table 890 below describes the starting and ending position of this segment on each transcript.

TABLE 890

Segment location on transcripts

| Transcript name | Segment starting position | Segment ending position |
|---|---|---|
| HUMCA1XIA_T16 (SEQ ID NO: 99) | 3181 | 3234 |

Segment cluster HUMCA1XIA_node_87 (SEQ ID NO:786) according to the present invention is supported by 10 libraries. The number of libraries was determined as previously described. This segment can be found in the following transcript(s): HUMCA1XIA_T16 (SEQ ID NO:99). Table 891 below describes the starting and ending position of this segment on each transcript.

TABLE 891

Segment location on transcripts

| Transcript name | Segment starting position | Segment ending position |
|---|---|---|
| HUMCA1XIA_T16 (SEQ ID NO: 99) | 3235 | 3342 |

Segment cluster HUMCA1XIA_node_89 (SEQ ID NO:787) according to the present invention is supported by 9 libraries. The number of libraries was determined as previously described. This segment can be found in the following transcript(s): HUMCA1XIA_T16 (SEQ ID NO:99). Table 892 below describes the starting and ending position of this segment on each transcript.

TABLE 892

Segment location on transcripts

| Transcript name | Segment starting position | Segment ending position |
|---|---|---|
| HUMCA1XIA_T16 (SEQ ID NO: 99) | 3343 | 3432 |

Segment cluster HUMCA1XIA_node_91 (SEQ ID NO:788) according to the present invention is supported by 11 libraries. The number of libraries was determined as previously described. This segment can be found in the following transcript(s): HUMCA1XIA_T16 (SEQ ID NO:99). Table 893 below describes the starting and ending position of this segment on each transcript.

TABLE 893

Segment location on transcripts

| Transcript name | Segment starting position | Segment ending position |
|---|---|---|
| HUMCA1XIA_T16 (SEQ ID NO: 99) | 3433 | 3486 |

Variant Protein Alignment to the Previously Known Protein:

Sequence name: CA1B_HUMAN_V5 (SEQ ID NO:1447)

Sequence documentation:

Alignment of: HUMCA1XIA_P14 (SEQ ID NO:1372) x CA1B_HUMAN_V5 (SEQ ID NO:1447) ..

Alignment segment 1/1:

| | |  | |
|---|---|---|---|
| Quality: | 10456.00 | Escore: | 0 |
| Matching length: | 1058 | Total length: | 1058 |
| Matching Percent Similarity: | 99.91 | Matching Percent Identity: | 99.91 |
| Total Percent Similarity: | 99.91 | Total Percent Identity: | 99.91 |
| Gaps: | 0 | | |

Alignment:

```
  1 MEPWSSRWKTKRWLWDFTVTTLALTFLFQAREVRGAAPVDVLKALDFHNS   50
    ||||||||||||||||||||||||||||||||||||||||||||||||||
  1 MEPWSSRWKTKRWLWDFTVTTLALTFLFQAREVRGAAPVDVLKALDFHNS   50

51 PEGISKTTGFCTNRKNSKGSDTAYRVSKQAQLSAPTKQLFPGGTFPEDFS  100
    ||||||||||||||||||||||||||||||||||||||||||||||||||
 51 PEGISKTTGFCTNRKNSKGSDTAYRVSKQAQLSAPTKQLFPGGTFPEDFS  100

101 ILFTVKPKKGIQSFLLSIYNEHGIQQIGVEVGRSPVFLFEDHTGKPAPED  150
    ||||||||||||||||||||||||||||||||||||||||||||||||||
101 ILFTVKPKKGIQSFLLSIYNEHGIQQIGVEVGRSPVFLFEDHTGKPAPED  150

151 YPLFRTVNIADGKWHRVAISVEKKTVTMIVDCKKKTTKPLDRSERAIVDT  200
    ||||||||||||||||||||||||||||||||||||||||||||||||||
151 YPLFRTVNIADGKWHRVAISVEKKTVTMIVDCKKKTTKPLDRSERAIVDT  200

201 NGITVFGTRILDEEVFEGDIQQFLITGDPKAAYDYCEHYSPDCDSSAPKA  250
    ||||||||||||||||||||||||||||||||||||||||||||||||||
201 NGITVFGTRILDEEVFEGDIQQFLITGDPKAAYDYCEHYSPDCDSSAPKA  250

251 AQAQEPQIDEYAPEDIIEYDYEYGEAEYKEAESVTEGPTVTEETIAQTEA  300
    ||||||||||||||||||||||||||||||||||||||||||||||||||
251 AQAQEPQIDEYAPEDIIEYDYEYGEAEYKEAESVTEGPTVTEETIAQTEA  300

301 NIVDDFQEYNYGTMESYQTEAPRHVSGTNEPNPVEEIFTEEYLTGEDYDS  350
    ||||||||||||||||||||||||||||||||||||||||||||||||||
301 NIVDDFQEYNYGTMESYQTEAPRHVSGTNEPNPVEEIFTEEYLTGEDYDS  350

351 QRKNSEDTLYENKEIDGRDSDLLVDGDLGEYDFYEYKEYEDKPTSPPNEE  400
    ||||||||||||||||||||||||||||||||||||||||||||||||||
351 QRKNSEDTLYENKEIDGRDSDLLVDGDLGEYDFYEYKEYEDKPTSPPNEE  400

401 FGPGVPAETDITETSINGHGAYGEKGQKGEPAVVEPGMLVEGPPGPAGPA  450
    ||||||||||||||||||||||||||||||||||||||||||||||||||
401 FGPGVPAETDITETSINGHGAYGEKGQKGEPAVVEPGMLVEGPPGPAGPA  450

451 GIMGPPGLQGPTGPPGDPGDRGPPGRPGLPGADGLPGPPGTMLMLPFRYG  500
    ||||||||||||||||||||||||||||||||||||||||||||||||||
451 GIMGPPGLQGPTGPPGDPGDRGPPGRPGLPGADGLPGPPGTMLMLPFRYG  500

501 GDGSKGPTISAQEAQAQAILQQARIALRGPPGPMGLTGRPGPVGGPGSSG  550
    ||||||||||||||||||||||||||||||||||||||||||||||||||
501 GDGSKGPTISAQEAQAQAILQQARIALRGPPGPMGLTGRPGPVGGPGSSG  550

551 AKGESGDPGPQGPRGVQGPPGPTGKPGKRGRPGADGGRGMPGEPGAKGDR  600
    ||||||||||||||||||||||||||||||||||||||||||||||||||
551 AKGESGDPGPQGPRGVQGPPGPTGKPGKRGRPGADGGRGMPGEPGAKGDR  600

601 GFDGLPGLPGDKGHRGETGPQGPPGPPGDDGMRGEDGEIGPRGLPGEAGP  650
    ||||||||||||||||||||||||||||||||||||||||||||||||||
601 GFDGLPGLPGDKGHRGETGPQGPPGPPGDDGMRGEDGEIGPRGLPGEAGP  650

651 RGLLGPRGTPGAPGQPGMAGVDGPPGPKGNMGPQGEPGPPGQQGNPGPQG  700
    ||||||||||||||||||||||||||||||||||||||||||||||||||
651 RGLLGPRGTPGAPGQPGMAGVDGPPGPKGNMGPQGEPGPPGQQGNPGPQG  700

701 LPGPQGPIGPPGEKGPQGKPGLAGLPGADGPPGHPGKEGQSGEKGALGPP  750
    ||||||||||||||||||||||||||||||||||||||||||||||||||
701 LPGPQGPIGPPGEKGPQGKPGLAGLPGADGPPGHPGKEGQSGEKGALGPP  750

751 GPQGPIGYPGPRGVKGADGVRGLKGSKGEKGEDGFPGFKGDMGLKGDRGE  800
    ||||||||||||||||||||||||||||||||||||||||||||||||||
751 GPQGPIGYPGPRGVKGADGVRGLKGSKGEKGEDGFPGFKGDMGLKGDRGE  800
```

-continued

```
 801 VGQIGPRGEDGPEGPKGRAGPTGDPGPSGQAGEKGKLGVPGLPGYPGRQG  850
     ||||||||||||||||||||||||||||||||||||||||||||||||||
 801 VGQIGPRGEDGPEGPKGRAGPTGDPGPSGQAGEKGKLGVPGLPGYPGRQG  850

851 PKGSTGFPGFPGANGEKGARGVAGKPGPRGQRGPTGPRGSRGARGPTGKP  900
     |||||||||||||||||||||||||||||||||||||||||||||||||
 851 PKGSTGFPGFPGANGEKGARGVAGKPGPRGQRGPTGPRGSRGARGPTGKP  900

901 GPKGTSGGDGPPGPPGERGPQGPQGPVGFPGPKGPPGPPGKDGLPGHPGQ  950
     |||||||||||||||||||||||||||||||||||||||||||||||||
 901 GPKGTSGGDGPPGPPGERGPQGPQGPVGFPGPKGPPGPPGKDGLPGHPGQ  950

951 RGETGFQGKTGPPGPGGVVGPQGPTGETGPIGERGHPGPPGPPGEQGLPG 1000
     |||||||||||||||||||||||||||||||||||||||||||||||||
 951 RGETGFQGKTGPPGPGGVVGPQGPTGETGPIGERGHPGPPGPPGEQGLPG 1000

1001 AAGKEGAKGDPGPQGISGKDGPAGLRGFPGERGLPGAQGAPGLKGGEGPQ 1050
     |||||||||||||||||||||||||||||||||||||||||||||||||
1001 AAGKEGAKGDPGPQGISGKDGPAGLRGFPGERGLPGAQGAPGLKGGEGPQ 1050

1051 GPPGPVVS                                          1058
     |||||| |
1051 GPPGPVGS                                          1058
```

Sequence name: CA1B_HUMAN (SEQ ID NO:1446)
Sequence documentation:
Alignment of: HUMCA1XIA_P15 (SEQ ID NO:1373) x CA1B_HUMAN (SEQ ID NO:1446) ..
Alignment segment 1/1:

| | | | |
|---|---|---|---|
| Quality: | 7073.00 | Escore: | 0 |
| Matching length: | 714 | Total length: | 714 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
   1 MEPWSSRWKTKRWLWDFTVTTLALTFLFQAREVRGAAPVDVLKALDFHNS  50
     ||||||||||||||||||||||||||||||||||||||||||||||||||
   1 MEPWSSRWKTKRWLWDFTVTTLALTFLFQAREVRGAAPVDVLKALDFHNS  50

51 PEGISKTTGFCTNRKNSKGSDTAYRVSKQAQLSAPTKQLFPGGTFPEDFS 100
     |||||||||||||||||||||||||||||||||||||||||||||||||
  51 PEGISKTTGFCTNRKNSKGSDTAYRVSKQAQLSAPTKQLFPGGTFPEDFS 100

101 ILFTVKPKKGIQSFLLSIYNEHGIQQIGVEVGRSPVFLFEDHTGKPAPED 150
     |||||||||||||||||||||||||||||||||||||||||||||||||
 101 ILFTVKPKKGIQSFLLSIYNEHGIQQIGVEVGRSPVFLFEDHTGKPAPED 150

151 YPLFRTVNIADGKWHRVAISVEKKTVTMIVDCKKKTTKPLDRSERAIVDT 200
     |||||||||||||||||||||||||||||||||||||||||||||||||
 151 YPLFRTVNIADGKWHRVAISVEKKTVTMIVDCKKKTTKPLDRSERAIVDT 200

201 NGITVFGTRILDEEVFEGDIQQFLITGDPKAAYDYCEHYSPDCDSSAPKA 250
     |||||||||||||||||||||||||||||||||||||||||||||||||
 201 NGITVFGTRILDEEVFEGDIQQFLITGDPKAAYDYCEHYSPDCDSSAPKA 250

251 AQAQEPQIDEYAPEDIIEYDYEYGEAEYKEAESVTEGPTVTEETIAQTEA 300
     |||||||||||||||||||||||||||||||||||||||||||||||||
 251 AQAQEPQIDEYAPEDIIEYDYEYGEAEYKEAESVTEGPTVTEETIAQTEA 300

301 NIVDDFQEYNYGTMESYQTEAPRHVSGTNEPNPVEEIFTEEYLTGEDYDS 350
     |||||||||||||||||||||||||||||||||||||||||||||||||
 301 NIVDDFQEYNYGTMESYQTEAPRHVSGTNEPNPVEEIFTEEYLTGEDYDS 350

351 QRKNSEDTLYENKEIDGRDSDLLVDGDLGEYDFYEYKEYEDKPTSPPNEE 400
     |||||||||||||||||||||||||||||||||||||||||||||||||
 351 QRKNSEDTLYENKEIDGRDSDLLVDGDLGEYDFYEYKEYEDKPTSPPNEE 400
```

```
401 FGPGVPAETDITETSINGHGAYGEKGQKGEPAVVEPGMLVEGPPGPAGPA 450
    ||||||||||||||||||||||||||||||||||||||||||||||||||
401 FGPGVPAETDITETSINGHGAYGEKGQKGEPAVVEPGMLVEGPPGPAGPA 450

451 GIMGPPGLQGPTGPPGDPGDRGPPGRPGLPGADGLPGPPGTMLMLPFRYG 500
    ||||||||||||||||||||||||||||||||||||||||||||||||||
451 GIMGPPGLQGPTGPPGDPGDRGPPGRPGLPGADGLPGPPGTMLMLPFRYG 500

501 GDGSKGPTISAQEAQAQAILQQARIALRGPPGPMGLTGRPGPVGGPGSSG 550
    ||||||||||||||||||||||||||||||||||||||||||||||||||
501 GDGSKGPTISAQEAQAQAILQQARIALRGPPGPMGLTGRPGPVGGPGSSG 550

551 AKGESGDPGPQGPRGVQGPPGPTGKPGKRGRPGADGGRGMPGEPGAKGDR 600
    ||||||||||||||||||||||||||||||||||||||||||||||||||
551 AKGESGDPGPQGPRGVQGPPGPTGKPGKRGRPGADGGRGMPGEPGAKGDR 600

601 GFDGLPGLPGDKGHRGETGPQGPPGPPGDDGMRGEDGEIGPRGLPGEAGP 650
    ||||||||||||||||||||||||||||||||||||||||||||||||||
601 GFDGLPGLPGDKGHRGETGPQGPPGPPGDDGMRGEDGEIGPRGLPGEAGP 650

651 RGLLGPRGTPGAPGQPGMAGVDGPPGPKGNMGPQGEPGPPGQQGNPGPQG 700
    ||||||||||||||||||||||||||||||||||||||||||||||||||
651 RGLLGPRGTPGAPGQPGMAGVDGPPGPKGNMGPQGEPGPPGQQGNPGPQG 700

701 LPGPQGPIGPPGEK                                    714
    ||||||||||||||
701 LPGPQGPIGPPGEK                                    714
```

Sequence name: CA1B_HUMAN (SEQ ID NO:1446)
Sequence documentation:
Alignment of: HUMCA1XIA_P16 (SEQ ID NO:1374) x CA1B_HUMAN (SEQ ID NO:1446) ..
Alignment segment 1/1:

| | | | |
|---|---|---|---|
| Quality: | 6795.00 | Escore: | 0 |
| Matching length: | 696 | Total length: | 714 |
| Matching Percent Similarity: | 100.00 | Matching Percent Identity: | 100.00 |
| Total Percent Similarity: | 97.48 | Total Percent Identity: | 97.48 |
| Gaps: | 1 | | |

Alignment:

```
  1 MEPWSSRWKTKRWLWDFTVTTLALTFLFQAREVRGAAPVDVLKALDFHNS  50
    ||||||||||||||||||||||||||||||||||||||||||||||||||
  1 MEPWSSRWKTKRWLWDFTVTTLALTFLFQAREVRGAAPVDVLKALDFHNS  50

51 PEGISKTTGFCTNRKNSKGSDTAYRVSKQAQLSAPTKQLFPGGTFPEDFS 100
    ||||||||||||||||||||||||||||||||||||||||||||||||||
 51 PEGISKTTGFCTNRKNSKGSDTAYRVSKQAQLSAPTKQLFPGGTFPEDFS 100

101 ILFTVKPKKGIQSFLLSIYNEHGIQQIGVEVGRSPVFLFEDHTGKPAPED 150
    ||||||||||||||||||||||||||||||||||||||||||||||||||
101 ILFTVKPKKGIQSFLLSIYNEHGIQQIGVEVGRSPVFLFEDHTGKPAPED 150

151 YPLFRTVNIADGKWHRVAISVEKKTVTMIVDCKKKTTKPLDRSERAIVDT 200
    ||||||||||||||||||||||||||||||||||||||||||||||||||
151 YPLFRTVNIADGKWHRVAISVEKKTVTMIVDCKKKTTKPLDRSERAIVDT 200

201 NGITVFGTRILDEEVFEGDIQQFLITGDPKAAYDYCEHYSPDCDSSAPKA 250
    ||||||||||||||||||||||||||||||||||||||||||||||||||
201 NGITVFGTRILDEEVFEGDIQQFLITGDPKAAYDYCEHYSPDCDSSAPKA 250

251 AQAQEPQIDEYAPEDIIEYDYEYGEAEYKEAESVTEGPTVTEETIAQTEA 300
    ||||||||||||||||||||||||||||||||||||||||||||||||||
251 AQAQEPQIDEYAPEDIIEYDYEYGEAEYKEAESVTEGPTVTEETIAQTEA 300

301 NIVDDFQEYNYGTMESYQTEAPRHVSGTNEPNPVEEIFTEEYLTGEDYDS 350
    ||||||||||||||||||||||||||||||||||||||||||||||||||
301 NIVDDFQEYNYGTMESYQTEAPRHVSGTNEPNPVEEIFTEEYLTGEDYDS 350
```

-continued

```
351 QRKNSEDTLYENKEIDGRDSDLLVDGDLGEYDFYEYKEYEDKPTSPPNEE 400
    ||||||||||||||||||||||||||||||||||||||||||||||||||
351 QRKNSEDTLYENKEIDGRDSDLLVDGDLGEYDFYEYKEYEDKPTSPPNEE 400

401 FGPGVPAETDITETSINGHGAYGEKGQKGEPAVVEPGMLVEGPPGPAGPA 450
    ||||||||||||||||||||||||||||||||||||||||||||||||||
401 FGPGVPAETDITETSINGHGAYGEKGQKGEPAVVEPGMLVEGPPGPAGPA 450

451 GIMGPPGLQGPTGPPGDPGDRGPPGRPGLPGADGLPGPPGTMLMLPFRYG 500
    ||||||||||||||||||||||||||||||||||||||||||||||||||
451 GIMGPPGLQGPTGPPGDPGDRGPPGRPGLPGADGLPGPPGTMLMLPFRYG 500

501 GDGSKGPTISAQEAQAQAILQQARIALRGPPGPMGLTGRPGPVGGPGSSG 550
    ||||||||||||||||||||||||||||||||||||||||||||||||||
501 GDGSKGPTISAQEAQAQAILQQARIALRGPPGPMGLTGRPGPVGGPGSSG 550

551 AKGESGDPGPQGPRGVQGPPGPTGKPGKRGRPGADGGRGMPGEPGAKGDR 600
    ||||||||||||||||||||||||||||||||||||||||||||||||||
551 AKGESGDPGPQGPRGVQGPPGPTGKPGKRGRPGADGGRGMPGEPGAKGDR 600

601 GFDGLPGLPGDKGHRGETGPQGPPGPPGDDGMRGEDGEIGPRGLPGEA.. 648
    ||||||||||||||||||||||||||||||||||||||||||||||||
601 GFDGLPGLPGDKGHRGETGPQGPPGPPGDDGMRGEDGEIGPRGLPGEAGP 650

649 ................GMAGVDGPPGPKGNMGPQGEPGPPGQQGNPGPQG 682
                    ||||||||||||||||||||||||||||||||||
651 RGLLGPRGTPGAPGQPGMAGVDGPPGPKGNMGPQGEPGPPGQQGNPGPQG 700

683 LPGPQGPIGPPGEK                                     696
    ||||||||||||||
701 LPGPQGPIGPPGEK                                     714
```

Sequence name: CA1B_HUMAN (SEQ ID NO:1446)
Sequence documentation:
Alignment of: HUMCA1XIA_P17 (SEQ ID NO:1375) x CA1B_HUMAN (SEQ ID NO:1446) ..
Alignment segment 1/1:

| | | | |
|---|---|---|---|
| Quality: | 2561.00 | Escore: | 0 |
| Matching length: | 260 | Total length: | 260 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MEPWSSRWKTKRWLWDFTVTTLALTFLFQAREVRGAAPVDVLKALDFHNS  50
    ||||||||||||||||||||||||||||||||||||||||||||||||||
  1 MEPWSSRWKTKRWLWDFTVTTLALTFLFQAREVRGAAPVDVLKALDFHNS  50

51 PEGISKTTGFCTNRKNSKGSDTAYRVSKQAQLSAPTKQLFPGGTFPEDFS 100
    ||||||||||||||||||||||||||||||||||||||||||||||||||
 51 PEGISKTTGFCTNRKNSKGSDTAYRVSKQAQLSAPTKQLFPGGTFPEDFS 100

101 ILFTVKPKKGIQSFLLSIYNEHGIQQIGVEVGRSPVFLFEDHTGKPAPED 150
    ||||||||||||||||||||||||||||||||||||||||||||||||||
101 ILFTVKPKKGIQSFLLSIYNEHGIQQIGVEVGRSPVFLFEDHTGKPAPED 150

151 YPLFRTVNIADGKWHRVAISVEKKTVTMIVDCKKKTTKPLDRSERAIVDT 200
    ||||||||||||||||||||||||||||||||||||||||||||||||||
151 YPLFRTVNIADGKWHRVAISVEKKTVTMIVDCKKKTTKPLDRSERAIVDT 200

201 NGITVFGTRILDEEVFEGDIQQFLITGDPKAAYDYCEHYSPDCDSSAPKA 250
    ||||||||||||||||||||||||||||||||||||||||||||||||||
201 NGITVFGTRILDEEVFEGDIQQFLITGDPKAAYDYCEHYSPDCDSSAPKA 250

251 AQAQEPQIDE                                         260
    ||||||||||
251 AQAQEPQIDE                                         260
```

Expression of *Homo sapiens* Collagen, Type XI, Alpha 1 (COL11A1) HUMCA1X1A Transcripts which are Detectable by Amplicon as Depicted in Sequence Name HUMCA1X1A seg55 (SEQ ID NO:1663) in Normal and Cancerous Lung Tissues Expression of *Homo sapiens* collagen, type XI, alpha 1 (COL11A1) transcripts detectable by or according to seg55, HUMCA1X1A seg55 amplicon (SEQ ID NO:1663) and primers HUMCA1X1A seg55F (SEQ ID NO:1661) and HUMCA1X1A seg55R (SEQ ID NO:1662) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO: 1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 67:
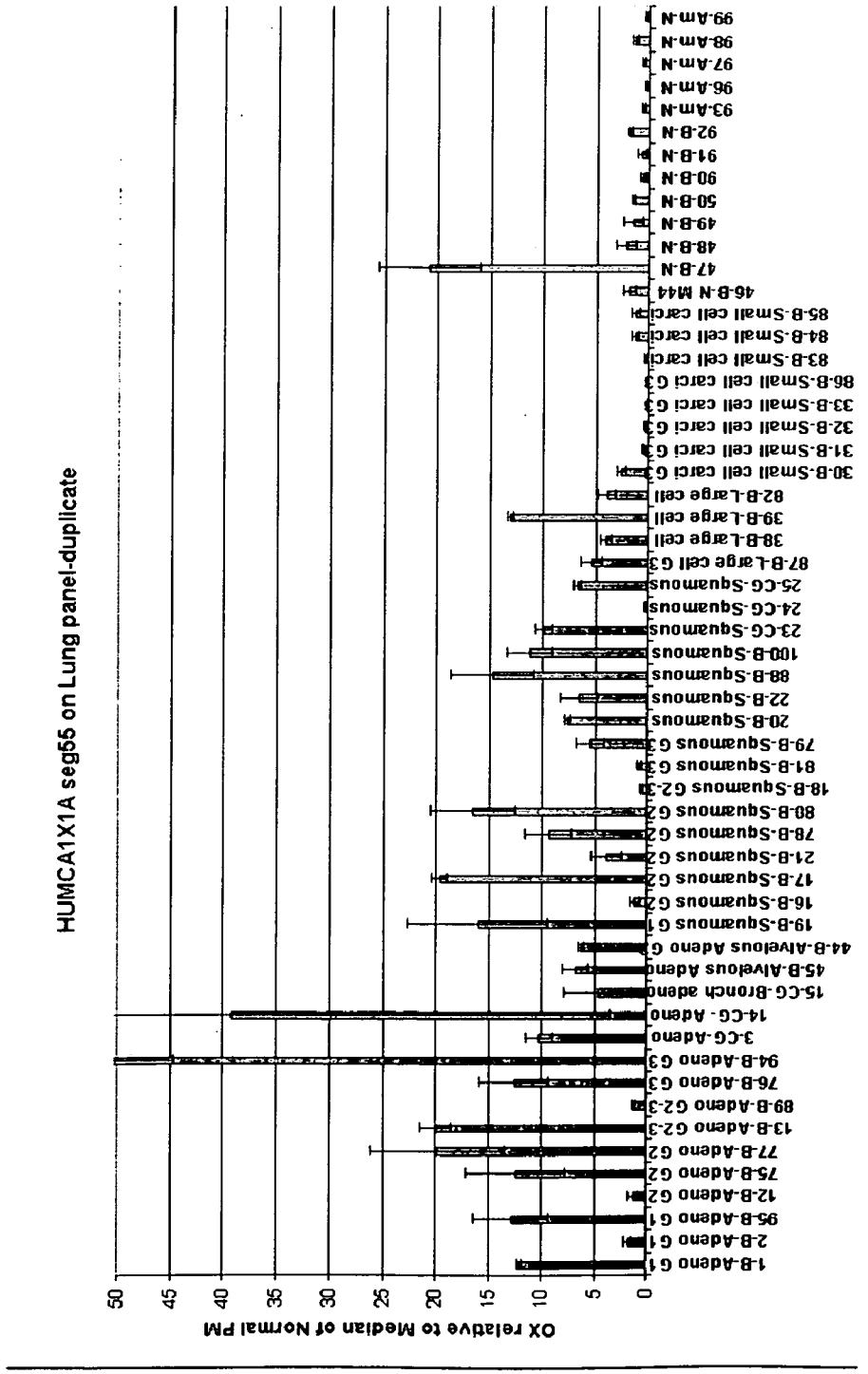
FIG. 67 is a histogram showing over expression of the above-indicated *Homo sapiens* collagen, type XI, alpha 1 (COL11A1) transcripts which are detectable by amplicon as depicted in sequence name HUMCA1X1A seg55 (SEQ ID NO:1663) in cancerous lung samples relative to the normal samples.

FIG. 67 is a histogram showing over expression of the above-indicated *Homo sapiens* collagen, type XI, alpha 1 (COL11A1) transcripts in cancerous lung samples relative to the normal samples. Values represent the average of duplicate experiments. Error bars indicate the minimal and maximal values obtained.

As is evident from FIG. 67, the expression of *Homo sapiens* collagen, type XI, alpha 1 (COL11A1) transcripts detectable by the above amplicon(s) in cancer samples was significantly higher than in the non-cancerous samples (Sample Nos. 47-50, 90-93, 96-99 Table 2). Notably an over-expression of at least 5 fold was found in 11 out of 15 adenocarcinoma samples, 11 out of 16 squamous cell carcinoma samples, and in 2 out of 4 large cell carcinoma samples.

Primer pairs are also optionally and preferably encompassed within the present invention; for example, for the above experiment, the following primer pair was used as a non-limiting illustrative example only of a suitable primer pair: HUMCA1X1A seg55F forward primer (SEQ ID NO:1661); and HUMCA1X1A seg55R reverse primer (SEQ ID NO:16623).

The present invention also preferably encompasses any amplicon obtained through the use of any suitable primer pair; for example, for the above experiment, the following amplicon was obtained as a non-limiting illustrative example only of a suitable amplicon: HUMCA1X1A seg55 (SEQ ID NO:1663).

Description for Cluster T11628

Cluster T11628 features 6 transcript(s) and 25 segment(s) of interest, the names for which are given in Tables 894 and 895, respectively, the sequences themselves are given at the end of the application. The selected protein variants are given in table 896.

TABLE 894

Transcripts of interest

| Transcript Name | Sequence ID No. |
|---|---|
| T11628_PEA_1_T3 | 103 |
| T11628_PEA_1_T4 | 104 |
| T11628_PEA_1_T5 | 105 |
| T11628_PEA_1_T7 | 106 |
| T11628_PEA_1_T9 | 107 |
| T11628_PEA_1_T11 | 108 |

TABLE 895

Segments of interest

| Segment Name | Sequence ID No. |
|---|---|
| T11628_PEA_1_node_7 | 789 |
| T11628_PEA_1_node_11 | 790 |
| T11628_PEA_1_node_16 | 791 |
| T11628_PEA_1_node_22 | 792 |
| T11628_PEA_1_node_25 | 793 |
| T11628_PEA_1_node_31 | 794 |
| T11628_PEA_1_node_37 | 795 |
| T11628_PEA_1_node_0 | 796 |
| T11628_PEA_1_node_4 | 797 |
| T11628_PEA_1_node_9 | 798 |
| T11628_PEA_1_node_13 | 799 |
| T11628_PEA_1_node_14 | 800 |
| T11628_PEA_1_node_17 | 801 |
| T11628_PEA_1_node_18 | 802 |
| T11628_PEA_1_node_19 | 803 |
| T11628_PEA_1_node_24 | 804 |
| T11628_PEA_1_node_27 | 805 |
| T11628_PEA_1_node_28 | 806 |
| T11628_PEA_1_node_29 | 807 |
| T11628_PEA_1_node_30 | 808 |
| T11628_PEA_1_node_32 | 809 |
| T11628_PEA_1_node_33 | 810 |
| T11628_PEA_1_node_34 | 811 |
| T11628_PEA_1_node_35 | 812 |
| T11628_PEA_1_node_36 | 813 |

```
Forward primer- HUMCA1X1A seg55F:   (SEQ ID NO: 1661)
TTCTCATAGTATTCCATTGATTGGGTA Reverse primer- HUMCA1X1A seg55R:   (SEQ ID NO: 1662)
CACCGGTATGGAGAATAGCGA Amplicon:                           (SEQ ID NO: 1663)
TTCTCATAGTATTCCATTGATTGGGTATACCAGGTTCTGTTTACTTTTACTTGGCAGT

TGATAGAATAGGTGTAGTTTATACTTTTTCGCTATTCTCCATACCGGTG
```

TABLE 896

Proteins of interest

| Protein Name | Sequence ID No. | Corresponding Transcript(s) |
|---|---|---|
| T11628_PEA_1_P2 | 1376 | T11628_PEA_1_T3 (SEQ ID NO: 103); T11628_PEA_1_T5 (SEQ ID NO: 105); T11628_PEA_1_T7 (SEQ ID NO: 106) |
| T11628_PEA_1_P5 | 1377 | T11628_PEA_1_T9 (SEQ ID NO: 107) |
| T11628_PEA_1_P7 | 1378 | T11628_PEA_1_T11 (SEQ ID NO: 108) |
| T11628_PEA_1_P10 | 1379 | T11628_PEA_1_T4 (SEQ ID NO: 104) |

These sequences are variants of the known protein Myoglobin (SwissProt accession identifier MYG_HUMAN), SEQ ID NO: 1448, referred to herein as the previously known protein.

Protein Myoglobin (SEQ ID NO:1448) is known or believed to have the following function(s): Serves as a reserve supply of oxygen and facilitates the movement of oxygen within muscles. The sequence for protein Myoglobin is given at the end of the application, as "Myoglobin amino acid sequence". Known polymorphisms for this sequence are as shown in Table 897.

TABLE 897

Amino acid mutations for Known Protein

| SNP position(s) on amino acid sequence | Comment |
|---|---|
| 54 | E -> K. /FTId = VAR_003180. |
| 133 | K -> N. /FTId = VAR_003181. |
| 139 | R -> Q. /FTId = VAR_003182. |
| 139 | R -> W. /FTId = VAR_003183. |
| 128 | Q -> E |

As noted above, cluster T11628 features 6 transcript(s), which were listed in Table 1 above. These transcript(s) encode for protein(s) which are variant(s) of protein Myoglobin (SEQ ID NO:1448). A description of each variant protein according to the present invention is now provided.

Variant protein T11628_PEA_1_P2 (SEQ ID NO:1376) according to the present invention has an amino acid sequence as given at the end of the application; it is encoded by transcript(s) T11628_PEA_1_T3 (SEQ ID NO:103). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison Report Between T11628_PEA_1_P2 (SEQ ID NO:1376) and Q8WVH6 (SEQ ID NO:1450):

1. An isolated chimeric polypeptide encoding for T11628_PEA_1_P2 (SEQ ID NO:1376) comprising a first amino acid sequence being at least 70%, optionally at least 80%, preferably at least 85%, more preferably at least 90% and most preferably at least 95% homologous to a polypeptide having the sequence MGLSDGEWQLVLN-VWGKVEADIPGHGQEVLIRLFKGH-PETLEKFDKFKHLKSEDE (SEQ ID NO:1735) corresponding to amino acids 1-55 of T11628_PEA_1_P2 (SEQ ID NO:1376), and a second amino acid sequence being at least 90% homologous to MKASEDLKKHGATVLTALG-GILKKKGHHEAEIKPLAQSHATKH-KIPVKYLEFISECIIQV LQSKHPGDFGADAQ-GAMNKALELFRKDMASNYKELGFQG corresponding to amino acids 1-99 of Q8WVH6 (SEQ ID NO:1450), which also corresponds to amino acids 56-154 of T11628_PEA_1_P2 (SEQ ID NO:1376), wherein said first amino acid sequence and second amino acid sequence are contiguous and in a sequential order.

2. An isolated polypeptide encoding for a head of T11628_PEA_1_P2 (SEQ ID NO:1376), comprising a polypeptide being at least 70%, optionally at least about 80%, preferably at least about 85%, more preferably at least about 90% and most preferably at least about 95% homologous to the sequence MGLSDGEWQLVLNVWGKVEADIPGH-GQEVLIRLFKGHPETLEKFDKFKHLKSEDE (SEQ ID NO:1735) of T11628_PEA_1_P2 (SEQ ID NO:1376).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P2 (SEQ ID NO:1376) also has the following non-silent SNPs (Single Nucleotide Polymorphisms) as listed in Table 898, (given according to their position(s) on the amino acid sequence, with the alternative amino acid(s) listed; the last column indicates whether the SNP is known or not; the presence of known SNPs in variant protein T11628_PEA_1_P2 (SEQ ID NO:1376) sequence provides support for the deduced sequence of this variant protein according to the present invention).

TABLE 898

Amino acid mutations

| SNP position(s) on amino acid sequence | Alternative amino acid(s) | Previously known SNP? |
|---|---|---|
| 26 | G -> | No |
| 44 | F -> | No |
| 92 | Q -> R | No |
| 135 | A -> | No |
| 141 | K -> | No |
| 153 | Q -> | No |

Variant protein T11628_PEA_1_P2 (SEQ ID NO:1376) is encoded by the following transcript(s): T11628_PEA_1_T3 (SEQ ID NO:103), for which the sequence(s) is/are given at the end of the application. The coding portion of transcript T11628_PEA_1_T3 (SEQ ID NO:103) is shown in bold; this coding portion starts at position 220 and ends at position 681. The transcript also has the following SNPs as listed in Table 899 (given according to their position on the nucleotide sequence, with the alternative nucleic acid listed; the last column indicates whether the SNP is known or not; the presence of known SNPs in variant protein T11628_PEA_1_P2 (SEQ ID NO:1376) sequence provides support for the deduced sequence of this variant protein according to the present invention).

TABLE 899

Nucleic acid SNPs

| SNP position on nucleotide sequence | Alternative nucleic acid | Previously known SNP? |
|---|---|---|
| 83 | G -> A | Yes |
| 93 | G -> A | Yes |
| 95 | G -> A | Yes |
| 146 | G -> A | Yes |
| 295 | G -> | No |
| 349 | T -> | No |
| 393 | G -> A | Yes |
| 423 | C -> T | Yes |
| 494 | A -> G | No |
| 498 | G -> A | No |
| 623 | C -> | No |
| 642 | G -> | No |
| 678 | G -> | No |
| 686 | C -> | No |
| 686 | C -> A | No |
| 717 | C -> | No |
| 787 | T -> G | No |
| 820 | G -> T | No |
| 826 | G -> T | No |
| 850 | C -> | No |
| 934 | T -> G | No |
| 975 | A -> G | Yes |
| 1117 | G -> | No |
| 1218 | A -> G | No |

Variant protein T11628_PEA_1_P5 (SEQ ID NO:1377) according to the present invention has an amino acid sequence as given at the end of the application; it is encoded by transcript(s) T11628_PEA_1_T9 (SEQ ID NO:107). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison Report Between T11628_PEA_1_P5 (SEQ ID NO:1377) and MYG_HUMAN_V1 (SEQ ID NO:1449):

1. An isolated chimeric polypeptide encoding for T11628_PEA_1_P5 (SEQ ID NO:1377), comprising a first amino acid sequence being at least 90% homologous to MKASEDLKKHGATVLTALGGILKKKGH-HEAEIKPLAQSHATKHKIPVKYLEFISECIIQV LQSKH-PGDFGADAQGAMNKALELFRKDMASNYKELGFQG corresponding to amino acids 56-154 of MYG_HUMAN_V1 (SEQ ID NO:1449), which also corresponds to amino acids 1-99 of T11628_PEA_1_P5 (SEQ ID NO:1377).

It should be noted that the known protein sequence (MYG_HUMAN (SEQ ID NO:1448)) has one or more changes than the sequence given at the end of the application and named as being the amino acid sequence for MYG_HUMAN_V1 (SEQ ID NO:1449). These changes were previously known to occur and are listed in the table below.

TABLE 900

Changes to MYG_HUMAN_V1 (SEQ ID NO: 1449)

| SNP position(s) on amino acid sequence | Type of change |
|---|---|
| 1 | init_met |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P5 (SEQ ID NO:1377) also has the following non-silent SNPs (Single Nucleotide Polymorphisms) as listed in Table 901, (given according to their position(s) on the amino acid sequence, with the alternative amino acid(s) listed; the last column indicates whether the SNP is known or not; the presence of known SNPs in variant protein T11628_PEA_1_P5 (SEQ ID NO:1377) sequence provides support for the deduced sequence of this variant protein according to the present invention).

TABLE 901

Amino acid mutations

| SNP position(s) on amino acid sequence | Alternative amino acid(s) | Previously known SNP? |
|---|---|---|
| 37 | Q -> R | No |
| 80 | A -> | No |
| 86 | K -> | No |
| 98 | Q -> | No |

Variant protein T11628_PEA_1_P5 (SEQ ID NO:1377) is encoded by the following transcript(s): T11628_PEA_1_T9 (SEQ ID NO:107), for which the sequence(s) is/are given at the end of the application. The coding portion of transcript T11628_PEA_1_T9 (SEQ ID NO:107) is shown in bold; this coding portion starts at position 211 and ends at position 507. The transcript also has the following SNPs as listed in Table 902 (given according to their position on the nucleotide sequence, with the alternative nucleic acid listed; the last column indicates whether the SNP is known or not; the presence of known SNPs in variant protein T11628_PEA_1_P5 (SEQ ID NO:1377) sequence provides support for the deduced sequence of this variant protein according to the present invention).

TABLE 902

Nucleic acid SNPs

| SNP position on nucleotide sequence | Alternative nucleic acid | Previously known SNP? |
|---|---|---|
| 2 | C -> T | Yes |
| 175 | T -> | No |
| 219 | G -> A | Yes |
| 249 | C -> T | Yes |
| 320 | A -> G | No |
| 324 | G -> A | No |
| 449 | C -> | No |
| 468 | G -> | No |
| 504 | G -> | No |
| 512 | C -> | No |
| 512 | C -> A | No |
| 543 | C -> | No |
| 613 | T -> G | No |
| 646 | G -> T | No |
| 652 | G -> T | No |
| 676 | C -> | No |
| 760 | T -> G | No |
| 801 | A -> G | Yes |
| 943 | G -> | No |
| 1044 | A -> G | No |

Variant protein T11628_PEA_1_P7 (SEQ ID NO:1378) according to the present invention has an amino acid sequence as given at the end of the application; it is encoded by transcript(s) T11628_PEA_1_T11 (SEQ ID NO:108). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison Report Between T11628_PEA_1_P7 (SEQ ID NO:1378) and MYG_HUMAN_V1 (SEQ ID NO:1449):

1. An isolated chimeric polypeptide encoding for T11628_PEA_1_P7 (SEQ ID NO:1378), comprising a first amino acid sequence being at least 90% homologous to MGLSDGEWQLVLNVWGKVEADIPGH-GQEVLIRLFKGHPETLEKFDKFKHLKSEDEMK ASEDLKKHGATVLTALGGILKKKGHHE-AEIKPLAQSHATKHKIPVKYLEFISECIIQVLQ SKH-PGDFGADAQGAMNK corresponding to amino acids 1-134 of MYG_HUMAN_V1 (SEQ ID NO:1449), which also corresponds to amino acids 1-134 of T11628_PEA_1_P7 (SEQ ID NO:1378), and a second amino acid sequence being at least 70%, optionally at least 80%, preferably at least 85%, more preferably at least 90% and most preferably at least 95% homologous to a polypeptide having the sequence G corresponding to amino acids 135-135 of T11628_PEA_1_P7 (SEQ ID NO:1378), wherein said first amino acid sequence and second amino acid sequence are contiguous and in a sequential order.

It should be noted that the known protein sequence (MYG_HUMAN (SEQ ID NO:1448)) has one or more changes than the sequence given at the end of the application and named as being the amino acid sequence for MYG_HUMAN_V1 (SEQ ID NO:1449). These changes were previously known to occur and are listed in the table below.

TABLE 903

Changes to MYG_HUMAN_V1 (SEQ ID NO: 1449)

| SNP position(s) on amino acid sequence | Type of change |
|---|---|
| 1 | init_met |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P7 (SEQ ID NO:1378) also has the following non-silent SNPs (Single Nucleotide Polymorphisms) as listed in Table 904, (given according to their position(s) on the amino acid sequence, with the alternative amino acid(s) listed; the last column indicates whether the SNP is known or not; the presence of known SNPs in variant protein T11628_PEA_1_P7 (SEQ ID NO:1378) sequence provides support for the deduced sequence of this variant protein according to the present invention).

TABLE 904

Amino acid mutations

| SNP position(s) on amino acid sequence | Alternative amino acid(s) | Previously known SNP? |
|---|---|---|
| 26 | G -> | No |
| 44 | F -> | No |
| 92 | Q -> R | No |

Variant protein T11628_PEA_1_P7 (SEQ ID NO:1378) is encoded by the following transcript(s): T11628_PEA_1_T11 (SEQ ID NO:108), for which the sequence(s) is/are given at the end of the application. The coding portion of transcript T11628_PEA_1_T11 (SEQ ID NO:108) is shown in bold; this coding portion starts at position 319 and ends at position 723. The transcript also has the following SNPs as listed in Table 905 (given according to their position on the nucleotide sequence, with the alternative nucleic acid listed; the last column indicates whether the SNP is known or not; the presence of known SNPs in variant protein T11628_PEA_1_P7 (SEQ ID NO:1378) sequence provides support for the deduced sequence of this variant protein according to the present invention).

TABLE 905

Nucleic acid SNPs

| SNP position on nucleotide sequence | Alternative nucleic acid | Previously known SNP? |
|---|---|---|
| 394 | G -> | No |
| 448 | T -> | No |
| 492 | G -> A | Yes |
| 522 | C -> T | Yes |
| 593 | A -> G | No |
| 597 | G -> A | No |
| 728 | C -> | No |
| 728 | C -> A | No |
| 759 | C -> | No |
| 829 | T -> G | No |
| 862 | G -> T | No |
| 868 | G -> T | No |
| 892 | C -> | No |
| 976 | T -> G | No |
| 1017 | A -> G | Yes |
| 1159 | G -> | No |
| 1260 | A -> G | No |

Variant protein T11628_PEA_1_P10 (SEQ ID NO:1379) according to the present invention has an amino acid sequence as given at the end of the application; it is encoded by transcript(s) T11628_PEA_1_T4 (SEQ ID NO:104). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison Report Between T11628_PEA_1_P10 (SEQ ID NO:1379) and Q8WVH6 (SEQ ID NO:1450):

1. An isolated chimeric polypeptide encoding for T11628_PEA_1_P10 (SEQ ID NO:1379), comprising a first amino acid sequence being at least 70%, optionally at least 80%, preferably at least 85%, more preferably at least 90% and most preferably at least 95% homologous to a polypeptide having the sequence MGLSDGEWQLVLN-VWGKVEADIPGHGQEVLIRLFKGH-PETLEKFDKFKHLKSEDE (SEQ ID NO:1735)

corresponding to amino acids 1-55 of T11628_PEA_1_P10 (SEQ ID NO:1379), and a second amino acid sequence being at least 90% homologous to MKASEDLKKHGATVLTALG-GILKKKGHHEAEIKPLAQSHATKH-KIPVKYLEFISECIIQV LQSKHPGDFGADAQ-GAMNKALELFRKDMASNYKELGFQG corresponding to amino acids 1-99 of Q8WVH6 (SEQ ID NO:1450), which also corresponds to amino acids 56-154 of T11628_PEA_1_P10 (SEQ ID NO:1379), wherein said first amino acid sequence and second amino acid sequence are contiguous and in a sequential order.

2. An isolated polypeptide encoding for a head of T11628_PEA_1_P10 (SEQ ID NO:1379), comprising a polypeptide being at least 70%, optionally at least about 80%, preferably at least about 85%, more preferably at least about 90% and most preferably at least about 95% homologous to the sequence MGLSDGEWQLVLNVWGKVEADIPGH-GQEVLIRLFKGHPETLEKFDKFKHLKSEDE (SEQ ID NO:1735) of T11628_PEA_1_P10 (SEQ ID NO:1379).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P10 (SEQ ID NO:1379) also has the following non-silent SNPs (Single Nucleotide Polymorphisms) as listed in Table 906, (given according to their position(s) on the amino acid sequence, with the alternative amino acid(s) listed; the last column indicates whether the SNP is known or not; the presence of known SNPs in variant protein T11628_PEA_1_P10 (SEQ ID NO:1379) sequence provides support for the deduced sequence of this variant protein according to the present invention).

TABLE 906

Amino acid mutations

| SNP position(s) on amino acid sequence | Alternative amino acid(s) | Previously known SNP? |
|---|---|---|
| 26 | G -> | No |
| 44 | F -> | No |
| 92 | Q -> R | No |
| 135 | A -> | No |
| 141 | K -> | No |
| 153 | Q -> | No |

Variant protein T11628_PEA_1_P10 (SEQ ID NO:1379) is encoded by the following transcript(s): T11628_PEA_1_T4 (SEQ ID NO:104), for which the sequence(s) is/are given at the end of the application. The coding portion of transcript T11628_PEA_1_T4 (SEQ ID NO:104) is shown in bold; this coding portion starts at position 205 and ends at position 666. The transcript also has the following SNPs as listed in Table 907 (given according to their position on the nucleotide sequence, with the alternative nucleic acid listed; the last column indicates whether the SNP is known or not; the presence of known SNPs in variant protein T11628_PEA_1_P10 (SEQ ID NO:1379) sequence provides support for the deduced sequence of this variant protein according to the present invention).

TABLE 907

Nucleic acid SNPs

| SNP position on nucleotide sequence | Alternative nucleic acid | Previously known SNP? |
|---|---|---|
| 280 | G -> | No |
| 334 | T -> | No |
| 378 | G -> A | Yes |
| 408 | C -> T | Yes |
| 479 | A -> G | No |
| 483 | G -> A | No |
| 608 | C -> | No |
| 627 | G -> | No |
| 663 | G -> | No |
| 671 | C -> | No |
| 671 | C -> A | No |
| 702 | C -> | No |
| 772 | T -> G | No |
| 805 | G -> T | No |
| 811 | G -> T | No |
| 835 | C -> | No |
| 919 | T -> G | No |
| 960 | A -> G | Yes |
| 1102 | G -> | No |
| 1203 | A -> G | No |

As noted above, cluster T11628 features 25 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T11628_PEA_1_node_7 (SEQ ID NO:789) according to the present invention is supported by 9 libraries. The number of libraries was determined as previously described. This segment can be found in the following transcript(s): T11628_PEA_1_T3 (SEQ ID NO:103). Table 908 below describes the starting and ending position of this segment on each transcript.

TABLE 908

Segment location on transcripts

| Transcript name | Segment starting position | Segment ending position |
|---|---|---|
| T11628_PEA_1_T3 (SEQ ID NO: 103) | 1 | 211 |

Segment cluster T11628_PEA_1_node_11 (SEQ ID NO:790) according to the present invention is supported by 1 libraries. The number of libraries was determined as previously described. This segment can be found in the following transcript(s): T11628_PEA_1_T5 (SEQ ID NO:105). Table 909 below describes the starting and ending position of this segment on each transcript.

TABLE 909

Segment location on transcripts

| Transcript name | Segment starting position | Segment ending position |
|---|---|---|
| T11628_PEA_1_T5 (SEQ ID NO: 105) | 48 | 178 |

Segment cluster T11628_PEA_1_node_16 (SEQ ID NO:791) according to the present invention is supported by 38 libraries. The number of libraries was determined as previously described. This segment can be found in the following transcript(s): T11628_PEA_1_T11 (SEQ ID NO:108). Table 910 below describes the starting and ending position of this segment on each transcript.

TABLE 910

Segment location on transcripts

| Transcript name | Segment starting position | Segment ending position |
| --- | --- | --- |
| T11628_PEA_1_T11 (SEQ ID NO: 108) | 1 | 214 |

Segment cluster T11628_PEA_1_node_22 (SEQ ID NO:792) according to the present invention is supported by 1 libraries. The number of libraries was determined as previously described. This segment can be found in the following transcript(s): T11628_PEA_1_T9 (SEQ ID NO:107). Table 911 below describes the starting and ending position of this segment on each transcript.

TABLE 911

Segment location on transcripts

| Transcript name | Segment starting position | Segment ending position |
| --- | --- | --- |
| T11628_PEA_1_T9 (SEQ ID NO: 107) | 1 | 140 |

Segment cluster T11628_PEA_1_node_25 (SEQ ID NO:793) according to the present invention is supported by 129 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 912 below describes the starting and ending position of this segment on each transcript.

TABLE 912

Segment location on transcripts

| Transcript name | Segment starting position | Segment ending position |
| --- | --- | --- |
| T11628_PEA_1_T3 (SEQ ID NO: 103) | 395 | 537 |
| T11628_PEA_1_T4 (SEQ ID NO: 104) | 380 | 522 |
| T11628_PEA_1_T5 (SEQ ID NO: 105) | 362 | 504 |
| T11628_PEA_1_T7 (SEQ ID NO: 106) | 347 | 489 |
| T11628_PEA_1_T9 (SEQ ID NO: 107) | 221 | 363 |
| T11628_PEA_1_T11 (SEQ ID NO: 108) | 494 | 636 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 913.

TABLE 913

Oligonucleotides related to this segment

| Oligonucleotide name | Overexpressed in cancers | Chip reference |
| --- | --- | --- |
| T11628_0_9_0 | lung malignant tumors | LUN |

Segment cluster T11628_PEA_1_node_31 (SEQ ID NO:794) according to the present invention is supported by 137 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 914 below describes the starting and ending position of this segment on each transcript.

TABLE 914

Segment location on transcripts

| Transcript name | Segment starting position | Segment ending position |
| --- | --- | --- |
| T11628_PEA_1_T3 (SEQ ID NO: 103) | 702 | 831 |
| T11628_PEA_1_T4 (SEQ ID NO: 104) | 687 | 816 |
| T11628_PEA_1_T5 (SEQ ID NO: 105) | 669 | 798 |
| T11628_PEA_1_T7 (SEQ ID NO: 106) | 654 | 783 |
| T11628_PEA_1_T9 (SEQ ID NO: 107) | 528 | 657 |
| T11628_PEA_1_T11 (SEQ ID NO: 108) | 744 | 873 |

Segment cluster T11628_PEA_1_node_37 (SEQ ID NO:795) according to the present invention is supported by 99 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 915 below describes the starting and ending position of this segment on each transcript.

TABLE 915

Segment location on transcripts

| Transcript name | Segment starting position | Segment ending position |
| --- | --- | --- |
| T11628_PEA_1_T3 (SEQ ID NO: 103) | 1086 | 1225 |
| T11628_PEA_1_T4 (SEQ ID NO: 104) | 1071 | 1210 |
| T11628_PEA_1_T5 (SEQ ID NO: 105) | 1053 | 1192 |
| T11628_PEA_1_T7 (SEQ ID NO: 106) | 1038 | 1177 |
| T11628_PEA_1_T9 (SEQ ID NO: 107) | 912 | 1051 |
| T11628_PEA_1_T11 (SEQ ID NO: 108) | 1128 | 1267 |

According to an optional embodiment of the present invention, short segments related to the above cluster are also provided. These segments are up to about 120 bp in length, and so are included in a separate description.

Segment cluster T11628_PEA_1_node_0 (SEQ ID NO:796) according to the present invention is supported by 1 libraries. The number of libraries was determined as previously described. This segment can be found in the following transcript(s): T11628_PEA_1_T4 (SEQ ID NO:104). Table 916 below describes the starting and ending position of this segment on each transcript.

TABLE 916

Segment location on transcripts

| Transcript name | Segment starting position | Segment ending position |
|---|---|---|
| T11628_PEA_1_T4 (SEQ ID NO: 104) | 1 | 93 |

Segment cluster T11628_PEA_1_node_4 (SEQ ID NO:797) according to the present invention is supported by 2 libraries. The number of libraries was determined as previously described. This segment can be found in the following transcript(s): T11628_PEA_1_T4 (SEQ ID NO:104). Table 917 below describes the starting and ending position of this segment on each transcript.

TABLE 917

Segment location on transcripts

| Transcript name | Segment starting position | Segment ending position |
|---|---|---|
| T11628_PEA_1_T4 (SEQ ID NO: 104) | 94 | 196 |

Segment cluster T11628_PEA_1_node_9 (SEQ ID NO:798) according to the present invention is supported by 16 libraries. The number of libraries was determined as previously described. This segment can be found in the following transcript(s): T11628_PEA_1_T5 (SEQ ID NO:105) and T11628_PEA_1_T7 (SEQ ID NO:106). Table 918 below describes the starting and ending position of this segment on each transcript.

TABLE 918

Segment location on transcripts

| Transcript name | Segment starting position | Segment ending position |
|---|---|---|
| T11628_PEA_1_T5 (SEQ ID NO: 105) | 1 | 47 |
| T11628_PEA_1_T7 (SEQ ID NO: 106) | 1 | 47 |

Segment cluster T11628_PEA_1_node_13 (SEQ ID NO:799) according to the present invention can be found in the following transcript(s): T11628_PEA_1_T7 (SEQ ID NO:106). Table 919 below describes the starting and ending position of this segment on each transcript.

TABLE 919

Segment location on transcripts

| Transcript name | Segment starting position | Segment ending position |
|---|---|---|
| T11628_PEA_1_T7 (SEQ ID NO: 106) | 48 | 65 |

Segment cluster T11628_PEA_1_node_14 (SEQ ID NO:800) according to the present invention is supported by 1 libraries. The number of libraries was determined as previously described. This segment can be found in the following transcript(s): T11628_PEA_1_T7 (SEQ ID NO:106). Table 920 below describes the starting and ending position of this segment on each transcript.

TABLE 920

Segment location on transcripts

| Transcript name | Segment starting position | Segment ending position |
|---|---|---|
| T11628_PEA_1_T7 (SEQ ID NO: 106) | 66 | 163 |

Segment cluster T11628_PEA_1_node_17 (SEQ ID NO:801) according to the present invention is supported by 55 libraries. The number of libraries was determined as previously described. This segment can be found in the following transcript(s): T11628_PEA_1_T11 (SEQ ID NO:108). Table 921 below describes the starting and ending position of this segment on each transcript.

TABLE 921

Segment location on transcripts

| Transcript name | Segment starting position | Segment ending position |
|---|---|---|
| T11628_PEA_1_T11 (SEQ ID NO: 108) | 215 | 310 |

Segment cluster T11628_PEA_1_node_18 (SEQ ID NO:802) according to the present invention is supported by 98 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106) and T11628_PEA_1_T11 (SEQ ID NO:108). Table 922 below describes the starting and ending position of this segment on each transcript.

TABLE 922

Segment location on transcripts

| Transcript name | Segment starting position | Segment ending position |
|---|---|---|
| T11628_PEA_1_T3 (SEQ ID NO: 103) | 212 | 289 |
| T11628_PEA_1_T4 (SEQ ID NO: 104) | 197 | 274 |
| T11628_PEA_1_T5 (SEQ ID NO: 105) | 179 | 256 |

TABLE 922-continued

Segment location on transcripts

| Transcript name | Segment starting position | Segment ending position |
|---|---|---|
| T11628_PEA_1_T7 (SEQ ID NO: 106) | 164 | 241 |
| T11628_PEA_1_T11 (SEQ ID NO: 108) | 311 | 388 |

Segment cluster T11628_PEA_1_node_19 (SEQ ID NO:803) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106) and T11628_PEA_1_T11 (SEQ ID NO:108). Table 923 below describes the starting and ending position of this segment on each transcript.

TABLE 923

Segment location on transcripts

| Transcript name | Segment starting position | Segment ending position |
|---|---|---|
| T11628_PEA_1_T3 (SEQ ID NO: 103) | 290 | 314 |
| T11628_PEA_1_T4 (SEQ ID NO: 104) | 275 | 299 |
| T11628_PEA_1_T5 (SEQ ID NO: 105) | 257 | 281 |
| T11628_PEA_1_T7 (SEQ ID NO: 106) | 242 | 266 |
| T11628_PEA_1_T11 (SEQ ID NO: 108) | 389 | 413 |

Segment cluster T11628_PEA_1_node_24 (SEQ ID NO:804) according to the present invention is supported by 112 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 924 below describes the starting and ending position of this segment on each transcript.

TABLE 924

Segment location on transcripts

| Transcript name | Segment starting position | Segment ending position |
|---|---|---|
| T11628_PEA_1_T3 (SEQ ID NO: 103) | 315 | 394 |
| T11628_PEA_1_T4 (SEQ ID NO: 104) | 300 | 379 |
| T11628_PEA_1_T5 (SEQ ID NO: 105) | 282 | 361 |
| T11628_PEA_1_T7 (SEQ ID NO: 106) | 267 | 346 |
| T11628_PEA_1_T9 (SEQ ID NO: 107) | 141 | 220 |
| T11628_PEA_1_T11 (SEQ ID NO: 108) | 414 | 493 |

Segment cluster T11628_PEA_1_node_27 (SEQ ID NO:805) according to the present invention is supported by 119 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 925 below describes the starting and ending position of this segment on each transcript.

TABLE 925

Segment location on transcripts

| Transcript name | Segment starting position | Segment ending position |
|---|---|---|
| T11628_PEA_1_T3 (SEQ ID NO: 103) | 538 | 621 |
| T11628_PEA_1_T4 (SEQ ID NO: 104) | 523 | 606 |
| T11628_PEA_1_T5 (SEQ ID NO: 105) | 505 | 588 |
| T11628_PEA_1_T7 (SEQ ID NO: 106) | 490 | 573 |
| T11628_PEA_1_T9 (SEQ ID NO: 107) | 364 | 447 |
| T11628_PEA_1_T11 (SEQ ID NO: 108) | 637 | 720 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 926

TABLE 926

Oligonucleotides related to this segment

| Oligonucleotide name | Overexpressed in cancers | Chip reference |
|---|---|---|
| T11628_0_9_0 | lung malignant tumors | LUN |

Segment cluster T11628_PEA_1_node_28 (SEQ ID NO:806) according to the present invention is supported by 115 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106) and T11628_PEA_1_T9 (SEQ ID NO:107). Table 927 below describes the starting and ending position of this segment on each transcript.

TABLE 927

Segment location on transcripts

| Transcript name | Segment starting position | Segment ending position |
|---|---|---|
| T11628_PEA_1_T3 (SEQ ID NO: 103) | 622 | 650 |
| T11628_PEA_1_T4 (SEQ ID NO: 104) | 607 | 635 |
| T11628_PEA_1_T5 (SEQ ID NO: 105) | 589 | 617 |
| T11628_PEA_1_T7 (SEQ ID NO: 106) | 574 | 602 |
| T11628_PEA_1_T9 (SEQ ID NO: 107) | 448 | 476 |

Segment cluster T11628_PEA_1_node_29 (SEQ ID NO:807) according to the present invention is supported by 113 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106) and T11628_PEA_1_T9 (SEQ ID NO:107). Table 928 below describes the starting and ending position of this segment on each transcript.

TABLE 928

Segment location on transcripts

| Transcript name | Segment starting position | Segment ending position |
|---|---|---|
| T11628_PEA_1_T3 (SEQ ID NO: 103) | 651 | 678 |
| T11628_PEA_1_T4 (SEQ ID NO: 104) | 636 | 663 |
| T11628_PEA_1_T5 (SEQ ID NO: 105) | 618 | 645 |
| T11628_PEA_1_T7 (SEQ ID NO: 106) | 603 | 630 |
| T11628_PEA_1_T9 (SEQ ID NO: 107) | 477 | 504 |

Segment cluster T11628_PEA_1_node_30 (SEQ ID NO:808) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 929 below describes the starting and ending position of this segment on each transcript.

TABLE 929

Segment location on transcripts

| Transcript name | Segment starting position | Segment ending position |
|---|---|---|
| T11628_PEA_1_T3 (SEQ ID NO: 103) | 679 | 701 |
| T11628_PEA_1_T4 (SEQ ID NO: 104) | 664 | 686 |
| T11628_PEA_1_T5 (SEQ ID NO: 105) | 646 | 668 |
| T11628_PEA_1_T7 (SEQ ID NO: 106) | 631 | 653 |
| T11628_PEA_1_T9 (SEQ ID NO: 107) | 505 | 527 |
| T11628_PEA_1_T11 (SEQ ID NO: 108) | 721 | 743 |

Segment cluster T11628_PEA_1_node_32 (SEQ ID NO:809) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 930 below describes the starting and ending position of this segment on each transcript.

TABLE 930

Segment location on transcripts

| Transcript name | Segment starting position | Segment ending position |
|---|---|---|
| T11628_PEA_1_T3 (SEQ ID NO: 103) | 832 | 844 |
| T11628_PEA_1_T4 (SEQ ID NO: 104) | 817 | 829 |
| T11628_PEA_1_T5 (SEQ ID NO: 105) | 799 | 811 |

TABLE 930-continued

Segment location on transcripts

| Transcript name | Segment starting position | Segment ending position |
|---|---|---|
| T11628_PEA_1_T7 (SEQ ID NO: 106) | 784 | 796 |
| T11628_PEA_1_T9 (SEQ ID NO: 107) | 658 | 670 |
| T11628_PEA_1_T11 (SEQ ID NO: 108) | 874 | 886 |

Segment cluster T11628_PEA_1_node_33 (SEQ ID NO:810) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 931 below describes the starting and ending position of this segment on each transcript.

TABLE 931

Segment location on transcripts

| Transcript name | Segment starting position | Segment ending position |
|---|---|---|
| T11628_PEA_1_T3 (SEQ ID NO: 103) | 845 | 866 |
| T11628_PEA_1_T4 (SEQ ID NO: 104) | 830 | 851 |
| T11628_PEA_1_T5 (SEQ ID NO: 105) | 812 | 833 |
| T11628_PEA_1_T7 (SEQ ID NO: 106) | 797 | 818 |
| T11628_PEA_1_T9 (SEQ ID NO: 107) | 671 | 692 |
| T11628_PEA_1_T11 (SEQ ID NO: 108) | 887 | 908 |

Segment cluster T11628_PEA_1_node_34 (SEQ ID NO:811) according to the present invention is supported by 122 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 932 below describes the starting and ending position of this segment on each transcript.

TABLE 932

Segment location on transcripts

| Transcript name | Segment starting position | Segment ending position |
|---|---|---|
| T11628_PEA_1_T3 (SEQ ID NO: 103) | 867 | 911 |
| T11628_PEA_1_T4 (SEQ ID NO: 104) | 852 | 896 |
| T11628_PEA_1_T5 (SEQ ID NO: 105) | 834 | 878 |
| T11628_PEA_1_T7 (SEQ ID NO: 106) | 819 | 863 |
| T11628_PEA_1_T9 (SEQ ID NO: 107) | 693 | 737 |
| T11628_PEA_1_T11 (SEQ ID NO: 108) | 909 | 953 |

Segment cluster T11628_PEA_1_node_35 (SEQ ID NO:812) according to the present invention is supported by 126 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T1 (SEQ ID NO:108). Table 933 below describes the starting and ending position of this segment on each transcript.

TABLE 933

Segment location on transcripts

| Transcript name | Segment starting position | Segment ending position |
| --- | --- | --- |
| T11628_PEA_1_T3 (SEQ ID NO: 103) | 912 | 967 |
| T11628_PEA_1_T4 (SEQ ID NO: 104) | 897 | 952 |
| T11628_PEA_1_T5 (SEQ ID NO: 105) | 879 | 934 |
| T11628_PEA_1_T7 (SEQ ID NO: 106) | 864 | 919 |
| T11628_PEA_1_T9 (SEQ ID NO: 107) | 738 | 793 |
| T11628_PEA_1_T11 (SEQ ID NO: 108) | 954 | 1009 |

Segment cluster T11628_PEA_1_node_36 (SEQ ID NO:813) according to the present invention is supported by 122 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 934 below describes the starting and ending position of this segment on each transcript.

TABLE 934

Segment location on transcripts

| Transcript name | Segment starting position | Segment ending position |
| --- | --- | --- |
| T11628_PEA_1_T3 (SEQ ID NO: 103) | 968 | 1085 |
| T11628_PEA_1_T4 (SEQ ID NO: 104) | 953 | 1070 |
| T11628_PEA_1_T5 (SEQ ID NO: 105) | 935 | 1052 |
| T11628_PEA_1_T7 (SEQ ID NO: 106) | 920 | 1037 |
| T11628_PEA_1_T9 (SEQ ID NO: 107) | 794 | 911 |
| T11628_PEA_1_T11 (SEQ ID NO: 108) | 1010 | 1127 |

Variant Protein Alignment to the Previously Known Protein:
Sequence name: Q8WVH6 (SEQ ID NO:1450)
Sequence documentation:
Alignment of: T11628_PEA_1_P2 (SEQ ID NO:1376) x Q8WVH6 (SEQ ID NO:1450) ..
Alignment segment 1/1:

| | | | |
| --- | --- | --- | --- |
| Quality: | 962.00 | Escore: | 0 |
| Matching length: | 99 | Total length: | 99 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 56 MKASEDLKKHGATVLTALGGILKKKGHHEAEIKPLAQSHATKHKIPVKYL 105
    |||||||||||||||||||||||||||||||||||||||||||||||||
  1 MKASEDLKKHGATVLTALGGILKKKGHHEAEIKPLAQSHATKHKIPVKYL  50

106 EFISECIIQVLQSKHPGDFGADAQGAMNKALELFRKDMASNYKELGFQG 154
    ||||||||||||||||||||||||||||||||||||||||||||||||
 51 EFISECIIQVLQSKHPGDFGADAQGAMNKALELFRKDMASNYKELGFQG  99
```

Sequence documentation:
Alignment of: T11628_PEA_1_P5 (SEQ ID NO:1377) x
   MYG_HUMAN_V1 (SEQ ID NO:1449)..
Alignment segment 1/1:

| | | | |
|---|---|---|---|
| Quality: | 962.00 | Escore: | 0 |
| Matching length: | 99 | Total length: | 99 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKASEDLKKHGATVLTALGGILKKKGHHEAEIKPLAQSHATKHKIPVKYL  50
    |||||||||||||||||||||||||||||||||||||||||||||||||
 56 MKASEDLKKHGATVLTALGGILKKKGHHEAEIKPLAQSHATKHKIPVKYL 105

51 EFISECIIQVLQSKHPGDFGADAQGAMNKALELFRKDMASNYKELGFQG   99
    ||||||||||||||||||||||||||||||||||||||||||||||||
106 EFISECIIQVLQSKHPGDFGADAQGAMNKALELFRKDMASNYKELGFQG  154
```

Sequence name: MYG_HUMAN_V1 (SEQ ID NO:1449)
Sequence documentation:
Alignment of: T11628_PEA_1_P7 (SEQ ID NO:1378) x
   MYG_HUMAN_V1 (SEQ ID NO:1449)..
Alignment segment 1/1:

| | | | |
|---|---|---|---|
| Quality: | 1315.00 | Escore: | 0 |
| Matching length: | 134 | Total length: | 134 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MGLSDGEWQLVLNVWGKVEADIPGHGQEVLIRLFKGHPETLEKFDKFKHL  50
    |||||||||||||||||||||||||||||||||||||||||||||||||
  1 MGLSDGEWQLVLNVWGKVEADIPGHGQEVLIRLFKGHPETLEKFDKFKHL  50

51 KSEDEMKASEDLKKHGATVLTALGGILKKKGHHEAEIKPLAQSHATKHKI 100
    |||||||||||||||||||||||||||||||||||||||||||||||||
 51 KSEDEMKASEDLKKHGATVLTALGGILKKKGHHEAEIKPLAQSHATKHKI 100

101 PVKYLEFISECIIQVLQSKHPGDFGADAQGAMNK                134
    ||||||||||||||||||||||||||||||||||
101 PVKYLEFISECIIQVLQSKHPGDFGADAQGAMNK                134
```

Sequence name: Q8WVH6 (SEQ ID NO:1450)
Sequence documentation:
Alignment of: T11628_PEA_1_P10 (SEQ ID NO:1379) x Q8WVH6 (SEQ ID NO:1450) ..
Alignment segment 1/1:

| | | | |
|---|---|---|---|
| Quality: | 962.00 | Escore: | 0 |
| Matching length: | 99 | Total length: | 99 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 56 MKASEDLKKHGATVLTALGGILKKKGHHEAEIKPLAQSHATKHKIPVKYL 105
    |||||||||||||||||||||||||||||||||||||||||||||||||
  1 MKASEDLKKHGATVLTALGGILKKKGHHEAEIKPLAQSHATKHKIPVKYL  50

106 EFISECIIQVLQSKHPGDFGADAQGAMNKALELFRKDMASNYKELGFQG 154
    ||||||||||||||||||||||||||||||||||||||||||||||||
 51 EFISECIIQVLQSKHPGDFGADAQGAMNKALELFRKDMASNYKELGFQG  99
```

Description for Cluster HUMCEA

Cluster HUMCEA features 5 transcript(s) and 42 segment(s) of interest, the names for which are given in Tables 935 and 936, respectively, the sequences themselves are given at the end of the application. The selected protein variants are given in table 937.

TABLE 935

Transcripts of interest

| Transcript Name | Sequence ID No. |
|---|---|
| HUMCEA_PEA_1_T8 | 109 |
| HUMCEA_PEA_1_T9 | 110 |
| HUMCEA_PEA_1_T20 | 111 |
| HUMCEA_PEA_1_T25 | 112 |
| HUMCEA_PEA_1_T26 | 113 |

TABLE 936

Segments of interest

| Segment Name | Sequence ID No. |
|---|---|
| HUMCEA_PEA_1_node_0 | 814 |
| HUMCEA_PEA_1_node_2 | 815 |
| HUMCEA_PEA_1_node_11 | 816 |
| HUMCEA_PEA_1_node_12 | 817 |
| HUMCEA_PEA_1_node_31 | 818 |
| HUMCEA_PEA_1_node_36 | 819 |
| HUMCEA_PEA_1_node_44 | 820 |
| HUMCEA_PEA_1_node_46 | 821 |
| HUMCEA_PEA_1_node_63 | 822 |
| HUMCEA_PEA_1_node_65 | 823 |
| HUMCEA_PEA_1_node_67 | 824 |
| HUMCEA_PEA_1_node_3 | 825 |
| HUMCEA_PEA_1_node_7 | 826 |
| HUMCEA_PEA_1_node_8 | 827 |
| HUMCEA_PEA_1_node_9 | 828 |
| HUMCEA_PEA_1_node_10 | 829 |
| HUMCEA_PEA_1_node_15 | 830 |
| HUMCEA_PEA_1_node_16 | 831 |
| HUMCEA_PEA_1_node_17 | 832 |

TABLE 936-continued

Segments of interest

| Segment Name | Sequence ID No. |
|---|---|
| HUMCEA_PEA_1_node_18 | 833 |
| HUMCEA_PEA_1_node_19 | 834 |
| HUMCEA_PEA_1_node_20 | 835 |
| HUMCEA_PEA_1_node_21 | 836 |
| HUMCEA_PEA_1_node_22 | 837 |
| HUMCEA_PEA_1_node_23 | 838 |
| HUMCEA_PEA_1_node_24 | 839 |
| HUMCEA_PEA_1_node_27 | 840 |
| HUMCEA_PEA_1_node_29 | 841 |
| HUMCEA_PEA_1_node_30 | 842 |

TABLE 936-continued

Segments of interest

| Segment Name | Sequence ID No. |
|---|---|
| HUMCEA_PEA_1_node_33 | 843 |
| HUMCEA_PEA_1_node_34 | 844 |
| HUMCEA_PEA_1_node_35 | 845 |
| HUMCEA_PEA_1_node_45 | 846 |
| HUMCEA_PEA_1_node_50 | 847 |
| HUMCEA_PEA_1_node_51 | 848 |
| HUMCEA_PEA_1_node_56 | 849 |
| HUMCEA_PEA_1_node_57 | 850 |
| HUMCEA_PEA_1_node_58 | 851 |
| HUMCEA_PEA_1_node_60 | 852 |
| HUMCEA_PEA_1_node_61 | 853 |
| HUMCEA_PEA_1_node_62 | 854 |
| HUMCEA_PEA_1_node_64 | 855 |

TABLE 937

Proteins of interest

| Protein Name | Sequence ID No. | Corresponding Transcript(s) |
|---|---|---|
| HUMCEA_PEA_1_P4 | 1380 | HUMCEA_PEA_1_T8 (SEQ ID NO: 109) |
| HUMCEA_PEA_1_P5 | 1381 | HUMCEA_PEA_1_T9 (SEQ ID NO: 110) |
| HUMCEA_PEA_1_P14 | 1382 | HUMCEA_PEA_1_T20 (SEQ ID NO: 111) |
| HUMCEA_PEA_1_P19 | 1383 | HUMCEA_PEA_1_T25 (SEQ ID NO: 112) |
| HUMCEA_PEA_1_P20 | 1384 | HUMCEA_PEA_1_T26 (SEQ ID NO: 113) |

These sequences are variants of the known protein Carcinoembryonic antigen-related cell adhesion molecule 5 precursor (SwissProt accession identifier CEA5_HUMAN; known also according to the synonyms Carcinoembryonic antigen; CEA; Meconium antigen 100; CD66e antigen), SEQ ID NO:1451, referred to herein as the previously known protein.

The sequence for protein Carcinoembryonic antigen-related cell adhesion molecule 5 precursor (SEQ ID NO:1451) is given at the end of the application, as "Carcinoembryonic antigen-related cell adhesion molecule 5 precursor amino acid sequence". Known polymorphisms for this sequence are as shown in Table 938

TABLE 938

Amino acid mutations for Known Protein

| SNP position(s) on amino acid sequence | Comment |
| --- | --- |
| 320 | Missing |

Protein Carcinoembryonic antigen-related cell adhesion molecule 5 precursor (SEQ ID NO:1451) localization is believed to be attached to the membrane by a GPI-anchor.

The previously known protein also has the following indication(s) and/or potential therapeutic use(s): Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Imaging agent; Anticancer; Immunostimulant; Immunoconjugate; Monoclonal antibody, murine; Antisense therapy; antibody.

The following GO Annotation(s) apply to the previously known protein. The following annotation(s) were found: integral plasma membrane protein; membrane, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

Cluster HUMCEA can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 33 refer to weighted expression of ESTs in each category, as "parts per million" (ratio of the expression of ESTs for a particular cluster to the expression of all ESTs in that category, according to parts per million).

Figure 33:
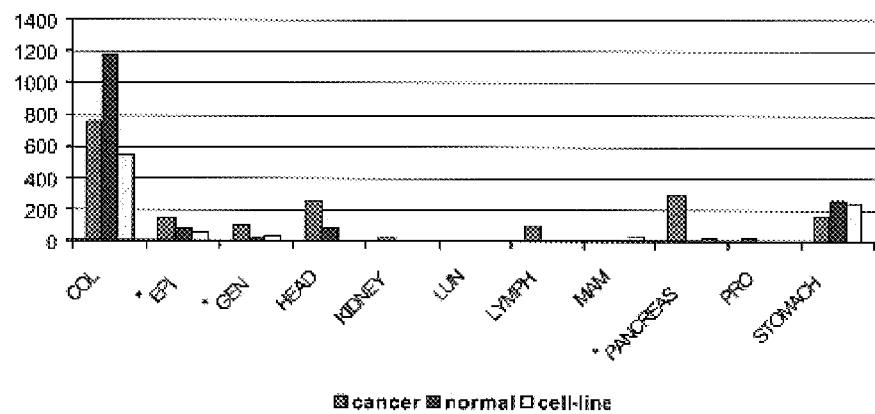
FIG. 33 is a histogram showing Cancer and cell-line vs. normal tissue expression for Cluster HUMCEA, demonstrating overexpression in epithelial malignant tumors, a mixture of malignant tumors from different tissues and pancreas carcinoma.

Overall, the following results were obtained as shown with regard to the histograms in FIG. 33 and Table 939. This cluster is overexpressed (at least at a minimum level) in the following pathological conditions: epithelial malignant tumors, a mixture of malignant tumors from different tissues and pancreas carcinoma.

TABLE 939

Normal tissue distribution

| Name of Tissue | Number |
| --- | --- |
| colon | 1175 |
| epithelial | 92 |

TABLE 939-continued

Normal tissue distribution

| Name of Tissue | Number |
| --- | --- |
| general | 29 |
| head and neck | 81 |
| kidney | 0 |
| lung | 0 |
| lymph nodes | 0 |
| breast | 0 |
| pancreas | 0 |
| prostate | 0 |
| stomach | 256 |

TABLE 940

P values and ratios for expression in cancerous tissue

| Name of Tissue | P1 | P2 | SP1 | R3 | SP2 | R4 |
| --- | --- | --- | --- | --- | --- | --- |
| colon | 2.0e−01 | 2.7e−01 | 9.8e−01 | 0.5 | 1 | 0.5 |
| epithelial | 2.1e−03 | 2.7e−02 | 6.4e−04 | 1.4 | 2.1e−01 | 1.0 |
| general | 3.9e−08 | 8.2e−06 | 9.2e−18 | 3.2 | 1.3e−10 | 2.2 |
| head and neck | 3.4e−01 | 5.0e−01 | 2.1e−01 | 1.8 | 5.6e−01 | 0.9 |
| kidney | 4.3e−01 | 5.3e−01 | 5.8e−01 | 2.1 | 7.0e−01 | 1.6 |
| lung | 1.3e−01 | 2.6e−01 | 1 | 1.1 | 1 | 1.1 |
| lymph nodes | 3.1e−01 | 5.7e−01 | 8.1e−02 | 6.0 | 3.3e−01 | 2.5 |
| breast | 3.8e−01 | 1.5e−01 | 1 | 1.0 | 6.8e−01 | 1.5 |
| pancreas | 2.2e−02 | 2.3e−02 | 1.4e−08 | 7.8 | 7.4e−07 | 6.4 |
| prostate | 5.3e−01 | 6.0e−01 | 3.0e−01 | 2.5 | 4.2e−01 | 2.0 |
| stomach | 1.5e−01 | 4.7e−01 | 8.9e−01 | 0.6 | 7.2e−01 | 0.4 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below (in relation to lung cancer), shown in Table 941.

TABLE 941

Oligonucleotides related to this cluster

| Oligonucleotide name | Overexpressed in cancers | Chip reference |
| --- | --- | --- |
| HUMCEA_0_0_15168 | lung malignant tumors | LUN |

As noted above, cluster HUMCEA features 5 transcript(s), which were listed in Table 1 above. These transcript(s) encode for protein(s) which are variant(s) of protein Carcinoembryonic antigen-related cell adhesion molecule 5 precursor (SEQ ID NO:1451). A description of each variant protein according to the present invention is now provided.

Variant protein HUMCEA_PEA_1_P4 (SEQ ID NO:1380) according to the present invention has an amino acid sequence as given at the end of the application; it is encoded by transcript(s) HUMCEA_PEA_1_T8 (SEQ ID NO:109). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison Report Between HUMCEA_PEA_1_P4 (SEQ ID NO:1380) and CEA5_HUMAN (SEQ ID NO:1451):

1. An isolated chimeric polypeptide encoding for HUMCEA_PEA_1_P4 (SEQ ID NO:1380), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILNVL corresponding to amino acids 1-234 of CEA5_HUMAN (SEQ ID NO:1451), which also corresponds to amino acids 1-234 of HUMCEA_PEA_1_P4 (SEQ ID NO:1380), and a second amino acid sequence being at least 70%, optionally at least 80%, preferably at least 85%, more preferably at least 90% and most preferably at least 95% homologous to a polypeptide having the sequence CEYICSSLAQAASPN-PQGQRQDFSVPLRFKYTDPQPWTSRLS-VTFCPRKTWADQVLTKN RRGGAASVLGGSGSTPYDGRNR (SEQ ID NO:1749) corresponding to amino acids 235-315 of HUMCEA_PEA_1_P4 (SEQ ID NO:1380), wherein said first amino acid sequence and second amino acid sequence are contiguous and in a sequential order.

2. An isolated polypeptide encoding for a tail of HUMCEA_PEA_1_P4 (SEQ ID NO:1380), comprising a polypeptide being at least 70%, optionally at least about 80%, preferably at least about 85%, more preferably at least about 90% and most preferably at least about 95% homologous to the sequence CEYICSSLAQAASPNPQGQRQDFSVPLR-FKYTDPQPWTSRLSVTFCPRKTWADQVLTKN RRG-GAASVLGGSGSTPYDGRNR (SEQ ID NO:1749) in HUMCEA_PEA_1_P4 (SEQ ID NO:1380).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P4 (SEQ ID NO:1380) also has the following non-silent SNPs (Single Nucleotide Polymorphisms) as listed in Table 942, (given according to their position(s) on the amino acid sequence, with the alternative amino acid(s) listed; the last column indicates whether the SNP is known or not; the presence of known SNPs in variant protein HUMCEA_PEA_1_P4 (SEQ ID NO:1380) sequence provides support for the deduced sequence of this variant protein according to the present invention).

TABLE 942

| SNP position(s) on amino acid sequence | Amino acid mutations | |
|---|---|---|
| | Alternative amino acid(s) | Previously known SNP? |
| 63 | F -> L | No |
| 80 | I -> V | Yes |

TABLE 942-continued

| SNP position(s) on amino acid sequence | Amino acid mutations | |
|---|---|---|
| | Alternative amino acid(s) | Previously known SNP? |
| 83 | V -> A | Yes |
| 137 | Q -> P | Yes |
| 173 | D -> N | No |

The glycosylation sites of variant protein HUMCEA_PEA_1_P4 (SEQ ID NO:1380), as compared to the known protein Carcinoembryonic antigen-related cell adhesion molecule 5 precursor (SEQ ID NO:1451), are described in Table 943 (given according to their position(s) on the amino acid sequence in the first column; the second column indicates whether the glycosylation site is present in the variant protein; and the last column indicates whether the position is different on the variant protein).

TABLE 943

| Glycosylation site(s) | | |
|---|---|---|
| Position(s) on known amino acid sequence | Present in variant protein? | Position in variant protein? |
| 197 | yes | 197 |
| 466 | no | |
| 360 | no | |
| 288 | no | |
| 665 | no | |
| 560 | no | |
| 650 | no | |
| 480 | no | |
| 104 | yes | 104 |
| 580 | no | |
| 204 | yes | 204 |
| 115 | yes | 115 |
| 208 | yes | 208 |
| 152 | yes | 152 |
| 309 | no | |
| 432 | no | |
| 351 | no | |
| 246 | no | |
| 182 | yes | 182 |
| 612 | no | |
| 256 | no | |
| 508 | no | |
| 330 | no | |
| 274 | no | |
| 292 | no | |
| 553 | no | |
| 529 | no | |
| 375 | no | |

Variant protein HUMCEA_PEA_1_P4 (SEQ ID NO:1380) is encoded by the following transcript(s): HUMCEA_PEA_1_T8 (SEQ ID NO:109), for which the sequence(s) is/are given at the end of the application. The coding portion of transcript HUMCEA_PEA_1_T8 (SEQ ID NO:109) is shown in bold; this coding portion starts at position 115 and ends at position 1059. The transcript also has the following SNPs as listed in Table 944 (given according to their position on the nucleotide sequence, with the alternative nucleic acid listed; the last column indicates whether the SNP is known or not; the presence of known SNPs in variant protein HUMCEA_PEA_1_P4 (SEQ ID NO:1380) sequence provides support for the deduced sequence of this variant protein according to the present invention).

TABLE 944

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 631 | G -> A | No |
| 1315 | A -> G | No |
| 1380 | T -> C | No |
| 1533 | C -> A | Yes |
| 1706 | G -> A | Yes |
| 2308 | T -> C | No |
| 2362 | C -> T | No |
| 2455 | A -> | No |
| 2504 | C -> A | Yes |
| 2558 | G -> | No |
| 2623 | G -> | No |
| 2639 | T -> A | No |
| 2640 | T -> A | No |
| 2832 | G -> A | Yes |
| 2885 | C -> T | No |
| 3396 | A -> G | Yes |
| 3562 | C -> T | Yes |
| 3753 | C -> T | Yes |

Variant protein HUMCEA_PEA_1_P5 (SEQ ID NO:1381) according to the present invention has an amino acid sequence as given at the end of the application; it is encoded by transcript(s) HUMCEA_PEA_1_T9 (SEQ ID NO:110). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison Report Between HUMCEA_PEA_1_P5 (SEQ ID NO:1381) and CEA5_HUMAN (SEQ ID NO:1451):

1. An isolated chimeric polypeptide encoding for HUMCEA_PEA_1_P5 (SEQ ID NO:1381), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILNVLYGPDA PTISPLNTSYRSGENLNLSCHAASNP-PAQYSWFVNGTFQQSTQELFIPNITVNNSGSYTC QAHNSDTGLNRTTVTTITVYAEPPK-PFITSNNSNPVEDEDAVALTCEPEIQNTTYLWWV NNQSLPVSPRLQLSNDNRTLTLLS-VTRNDVGPYECGIQNELSVDHSDPVILNVLYGPDD PTISPSYTYYRPGVNLSLSCHAASNP-PAQYSWLIDGNIQQHTQELFISNITEKNSGLYTCQ ANNSASGHSRTTVKTITVSAELPKP-SISSNNSKPVEDKDAVAFTCEPEAQNTTYLWWVN GQSLPVSPRLQLSNGNRTLTLFNVTRN-DARAYVCGIQNSVSANRSDPVTLDVLYGPDTP IISPP-DSSYLSGANLNLSCHSAS-NPSPQYSWRINGIPQQHTQVLFIAKITPNNNGTYACFV SNLATGRNNSIVKSITVS corresponding to amino acids 1-675 of CEA5_HUMAN (SEQ ID NO:1451), which also corresponds to amino acids 1-675 of HUMCEA_PEA_1_P5 (SEQ ID NO:1381), and a second amino acid sequence being at least 70%, optionally at least 80%, preferably at least 85%, more preferably at least 90% and most preferably at least 95% homologous to a polypeptide having the sequence GKWLP-GASASYSGVESIWFSPKSQEDIFF-PSLCSMGTRKSQILS (SEQ ID NO:1750) corresponding to amino acids 676-719 of HUMCEA_PEA_1_P5 (SEQ ID NO:1381), wherein said first amino acid sequence and second amino acid sequence are contiguous and in a sequential order.

2. An isolated polypeptide encoding for a tail of HUMCEA_PEA_1_P5 (SEQ ID NO:1381), comprising a polypeptide being at least 70%, optionally at least about 80%, preferably at least about 85%, more preferably at least about 90% and most preferably at least about 95% homologous to the sequence GKWLPGASASYSGVESIWFSPKSQEDIF-FPSLCSMGTRKSQILS (SEQ ID NO:1750) in HUMCEA_PEA_1_P5 (SEQ ID NO:1381).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P5 (SEQ ID NO:1381) also has the following non-silent SNPs (Single Nucleotide Polymorphisms) as listed in Table 945, (given according to their position(s) on the amino acid sequence, with the alternative amino acid(s) listed; the last column indicates whether the SNP is known or not; the presence of known SNPs in variant protein HUMCEA_PEA_1_P5 (SEQ ID NO:1381) sequence provides support for the deduced sequence of this variant protein according to the present invention).

TABLE 945

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 173 | D -> N | No |
| 289 | I -> T | No |
| 340 | A -> D | Yes |
| 398 | E -> K | Yes |
| 647 | P -> | No |
| 664 | R -> S | Yes |

The glycosylation sites of variant protein HUMCEA_PEA_1_P5 (SEQ ID NO:1381), as compared to the known protein Carcinoembryonic antigen-related cell adhesion molecule 5 precursor (SEQ ID NO:1451), are described in Table 946 (given according to their position(s) on the amino acid sequence in the first column; the second column indicates whether the glycosylation site is present in the variant protein; and the last column indicates whether the position is different on the variant protein).

TABLE 946

Glycosylation site(s)

| Position(s) on known amino acid sequence | Present in variant protein? | Position in variant protein? |
| --- | --- | --- |
| 197 | yes | 197 |
| 466 | yes | 466 |
| 360 | yes | 360 |
| 288 | yes | 288 |
| 665 | yes | 665 |
| 560 | yes | 560 |
| 650 | yes | 650 |
| 480 | yes | 480 |
| 104 | yes | 104 |
| 580 | yes | 580 |
| 204 | yes | 204 |
| 115 | yes | 115 |
| 208 | yes | 208 |
| 152 | yes | 152 |
| 309 | yes | 309 |
| 432 | yes | 432 |
| 351 | yes | 351 |
| 246 | yes | 246 |
| 182 | yes | 182 |
| 612 | yes | 612 |
| 256 | yes | 256 |
| 508 | yes | 508 |
| 330 | yes | 330 |
| 274 | yes | 274 |
| 292 | yes | 292 |
| 553 | yes | 553 |
| 529 | yes | 529 |
| 375 | yes | 375 |

Variant protein HUMCEA_PEA_1_P5 (SEQ ID NO:1381) is encoded by the following transcript(s): HUMCEA_PEA_1_T9 (SEQ ID NO:110), for which the sequence(s) is/are given at the end of the application. The coding portion of transcript HUMCEA_PEA_1_T9 (SEQ ID NO:110) is shown in bold; this coding portion starts at position 115 and ends at position 2271. The transcript also has the following SNPs as listed in Table 947 (given according to their position on the nucleotide sequence, with the alternative nucleic acid listed; the last column indicates whether the SNP is known or not; the presence of known SNPs in variant protein HUMCEA_PEA_1_P5 (SEQ ID NO:1381) sequence provides support for the deduced sequence of this variant protein according to the present invention).

TABLE 947

Nucleic acid SNPs

| SNP position on nucleotide sequence | Alternative nucleic acid | Previously known SNP? |
| --- | --- | --- |
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 631 | G -> A | No |
| 915 | A -> G | No |
| 980 | T -> C | No |
| 1133 | C -> A | Yes |
| 1306 | G -> A | Yes |
| 1908 | T -> C | No |
| 1962 | C -> T | No |
| 2055 | A -> | No |

TABLE 947-continued

Nucleic acid SNPs

| SNP position on nucleotide sequence | Alternative nucleic acid | Previously known SNP? |
| --- | --- | --- |
| 2104 | C -> A | Yes |
| 3259 | T -> C | Yes |

Variant protein HUMCEA_PEA_1_P14 (SEQ ID NO:1382) according to the present invention has an amino acid sequence as given at the end of the application; it is encoded by transcript(s) HUMCEA_PEA_1_T20 (SEQ ID NO:111). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P14 (SEQ ID NO:1382) also has the following non-silent SNPs (Single Nucleotide Polymorphisms) as listed in Table 948, (given according to their position(s) on the amino acid sequence, with the alternative amino acid(s) listed; the last column indicates whether the SNP is known or not; the presence of known SNPs in variant protein HUMCEA_PEA_1_P14 (SEQ ID NO:1382) sequence provides support for the deduced sequence of this variant protein according to the present invention).

TABLE 948

Amino acid mutations

| SNP position(s) on amino acid sequence | Alternative amino acid(s) | Previously known SNP? |
| --- | --- | --- |
| 63 | F -> L | No |
| 80 | I -> V | Yes |
| 83 | V -> A | Yes |
| 137 | Q -> P | Yes |
| 173 | D -> N | No |
| 289 | I -> T | No |
| 340 | A -> D | Yes |
| 398 | E -> K | Yes |

Variant protein HUMCEA_PEA_1_P14 (SEQ ID NO:1382) is encoded by the following transcript(s): HUMCEA_PEA_1_T20 (SEQ ID NO:111), for which the sequence(s) is/are given at the end of the application. The coding portion of transcript HUMCEA_PEA_1_T20 (SEQ ID NO:111) is shown in bold; this coding portion starts at position 115 and ends at position 1821. The transcript also has the following SNPs as listed in Table 949 (given according to their position on the nucleotide sequence, with the alternative nucleic acid listed; the last column indicates whether the SNP is known or not; the presence of known SNPs in variant protein HUMCEA_PEA_1_P14 (SEQ ID NO:1382) sequence provides support for the deduced sequence of this variant protein according to the present invention).

TABLE 949

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 631 | G -> A | No |
| 915 | A -> G | No |
| 980 | T -> C | No |
| 1133 | C -> A | Yes |
| 1306 | G -> A | Yes |

Variant protein HUMCEA_PEA_1_P19 (SEQ ID NO:1383) according to the present invention has an amino acid sequence as given at the end of the application; it is encoded by transcript(s) HUMCEA_PEA_1_T25 (SEQ ID NO:112). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison Report Between HUMCEA_PEA_1_P19 (SEQ ID NO:1383) and CEA5_HUMAN (SEQ ID NO:1451):

1. An isolated chimeric polypeptide encoding for HUMCEA_PEA_1_P 19 (SEQ ID NO:1383), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYPELPKP-SISSNNSKPVEDKDAVAFTCEPETQDATYLWWV NNQSLPVSPRLQLSNGNRTLTLFN-VTRNDTASYKCETQNPVSARRSDSVILN corresponding to amino acids 1-232 of CEA5_HUMAN (SEQ ID NO:1451), which also corresponds to amino acids 1-232 of HUMCEA_PEA_1_P19 (SEQ ID NO:1383), and a second amino acid sequence being at least 90% homologous to VLYGPDTPIISPPDSSYLSGANLNLSCH-SASNPSPQYSWRINGIPQQHTQVLFIAKITPNNN GTY-ACFVSNLATGRNNSIVKSITVSAS-GTSPGLSAGATVGIMIGVLVGVALI corresponding to amino acids 589-702 of CEA5_HUMAN (SEQ ID NO:1451), which also corresponds to amino acids 233-346 of HUMCEA_PEA_1_P19 (SEQ ID NO:1383), wherein said first amino acid sequence and second amino acid sequence are contiguous and in a sequential order.

2. An isolated chimeric polypeptide encoding for an edge portion of HUMCEA_PEA_1_P19 (SEQ ID NO:1383), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NV, having a structure as follows: a sequence starting from any of amino acid numbers 232-x to 232; and ending at any of amino acid numbers 233+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure.

Variant protein HUMCEA_PEA_1_P19 (SEQ ID NO:1383) also has the following non-silent SNPs (Single Nucleotide Polymorphisms) as listed in Table 950, (given according to their position(s) on the amino acid sequence, with the alternative amino acid(s) listed; the last column indicates whether the SNP is known or not; the presence of known SNPs in variant protein HUMCEA_PEA_1_P19 (SEQ ID NO:1383) sequence provides support for the deduced sequence of this variant protein according to the present invention).

TABLE 950

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 173 | D -> N | No |
| 291 | P -> | No |
| 308 | R -> S | Yes |
| 326 | G -> | No |

The glycosylation sites of variant protein HUMCEA_PEA_1_P19 (SEQ ID NO:1383), as compared to the known protein Carcinoembryonic antigen-related cell adhesion molecule 5 precursor (SEQ ID NO:1451), are described in Table 951 (given according to their position(s) on the amino acid sequence in the first column; the second column indicates whether the glycosylation site is present in the variant protein; and the last column indicates whether the position is different on the variant protein).

TABLE 951

Glycosylation site(s)

| Position(s) on known amino acid sequence | Present in variant protein? | Position in variant protein? |
|---|---|---|
| 197 | yes | 197 |
| 466 | no | |
| 360 | no | |
| 288 | no | |
| 665 | yes | 309 |
| 560 | no | |
| 650 | yes | 294 |
| 480 | no | |
| 104 | yes | 104 |
| 580 | no | |
| 204 | yes | 204 |
| 115 | yes | 115 |
| 208 | yes | 208 |
| 152 | yes | 152 |
| 309 | no | |
| 432 | no | |
| 351 | no | |
| 246 | no | |
| 182 | yes | 182 |

TABLE 951-continued

Glycosylation site(s)

| Position(s) on known amino acid sequence | Present in variant protein? | Position in variant protein? |
|---|---|---|
| 612 | yes | 256 |
| 256 | no | |
| 508 | no | |
| 330 | no | |
| 274 | no | |
| 292 | no | |
| 553 | no | |
| 529 | no | |
| 375 | no | |

Variant protein HUMCEA_PEA_1_P19 (SEQ ID NO:1383) is encoded by the following transcript(s): HUMCEA_PEA_1_T25 (SEQ ID NO:112), for which the sequence(s) is/are given at the end of the application. The coding portion of transcript HUMCEA_PEA_1_T25 (SEQ ID NO:112) is shown in bold; this coding portion starts at position 115 and ends at position 1152. The transcript also has the following SNPs as listed in Table 952 (given according to their position on the nucleotide sequence, with the alternative nucleic acid listed; the last column indicates whether the SNP is known or not; the presence of known SNPs in variant protein HUMCEA_PEA_1_P19 (SEQ ID NO:1383) sequence provides support for the deduced sequence of this variant protein according to the present invention).

TABLE 952

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 631 | G -> A | No |
| 840 | T -> C | No |
| 894 | C -> T | No |
| 987 | A -> | No |
| 1036 | C -> A | Yes |
| 1090 | G -> | No |
| 1155 | G -> | No |
| 1171 | T -> A | No |
| 1172 | T -> A | No |
| 1364 | G -> A | Yes |
| 1417 | C -> T | No |
| 1928 | A -> G | Yes |
| 2094 | C -> T | Yes |
| 2285 | C -> T | Yes |

Variant protein HUMCEA_PEA_1_P20 (SEQ ID NO:1384) according to the present invention has an amino acid sequence as given at the end of the application; it is encoded by transcript(s) HUMCEA_PEA_1_T26 (SEQ ID NO:113). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison Report Between HUMCEA_PEA_1_P20 (SEQ ID NO:1384) and CEA5_HUMAN (SEQ ID NO:1451):

1. An isolated chimeric polypeptide encoding for HUMCEA_PEA_1_P20 (SEQ ID NO:1384), comprising a first amino acid sequence being at least 90% homologous to MESPSAPPHRWCIPWQRLLLTASLLTF-WNPPTTAKLTIESTPFNVAEGKEVLLLVHNLPQ HLF-GYSWYKGERVDGNRQIIGYVIGTQQAT-PGPAYSGREIIYPNASLLIQNIIQNDTGFYT LHVIKSDLVNEEATGQFRVYP corresponding to amino acids 1-142 of CEA5_HUMAN (SEQ ID NO:1451), which also corresponds to amino acids 1-142 of HUMCEA_PEA_1_P20 (SEQ ID NO:1384), and a second amino acid sequence being at least 90% homologous to ELPKPSISSNNSKPVED-KDAVAFTCEPEAQNTTYLWWVNGQS-LPVSPRLQLSNGNRTLT LFNVTRNDARAYVCGIQNS-VSANRSDPVTLDVLYGPDTPIISPPDSSYLSGANL NLSCHS ASNPSPQYSWRINGIPQQHTQVLFIAK-ITPNNNGTYACFVSNLATGRNNSIVKSITVSASG TSPGLSAGATVGIMIGVLVGVALI corresponding to amino acids 499-702 of CEA5_HUMAN (SEQ ID NO:1451), which also corresponds to amino acids 143-346 of HUMCEA_PEA_1_P20 (SEQ ID NO:1384), wherein said first amino acid sequence and second amino acid sequence are contiguous and in a sequential order.

2. An isolated chimeric polypeptide encoding for an edge portion of HUMCEA_PEA_1_P20 (SEQ ID NO:1384), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PE, having a structure as follows: a sequence starting from any of amino acid numbers 142−x to 142; and ending at any of amino acid numbers 143+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure.

Variant protein HUMCEA_PEA_1_P20 (SEQ ID NO:1384) also has the following non-silent SNPs (Single Nucleotide Polymorphisms) as listed in Table 953, (given according to their position(s) on the amino acid sequence, with the alternative amino acid(s) listed; the last column indicates whether the SNP is known or not; the presence of known SNPs in variant protein HUMCEA_PEA_1_P20 (SEQ ID NO:1384) sequence provides support for the deduced sequence of this variant protein according to the present invention).

TABLE 953

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 291 | P -> | No |

TABLE 953-continued

Amino acid mutations

| SNP position(s) on amino acid sequence | Alternative amino acid(s) | Previously known SNP? |
|---|---|---|
| 308 | R -> S | Yes |
| 326 | G -> | No |

The glycosylation sites of variant protein HUMCEA_PEA_1_P20 (SEQ ID NO:1384), as compared to the known protein Carcinoembryonic antigen-related cell adhesion molecule 5 precursor (SEQ ID NO:1451), are described in Table 954 (given according to their position(s) on the amino acid sequence in the first column; the second column indicates whether the glycosylation site is present in the variant protein; and the last column indicates whether the position is different on the variant protein).

TABLE 954

Glycosylation site(s)

| Position(s) on known amino acid sequence | Present in variant protein? | Position in variant protein? |
|---|---|---|
| 197 | no | |
| 466 | no | |
| 360 | no | |
| 288 | no | |
| 665 | yes | 309 |
| 560 | yes | 204 |
| 650 | yes | 294 |
| 480 | no | |
| 104 | yes | 104 |
| 580 | yes | 224 |
| 204 | no | |
| 115 | yes | 115 |
| 208 | no | |
| 152 | no | |
| 309 | no | |
| 432 | no | |
| 351 | no | |
| 246 | no | |
| 182 | no | |
| 612 | yes | 256 |
| 256 | no | |
| 508 | yes | 152 |
| 330 | no | |
| 274 | no | |
| 292 | no | |
| 553 | yes | 197 |
| 529 | yes | 173 |
| 375 | no | |

Variant protein HUMCEA_PEA_1_P20 (SEQ ID NO:1384) is encoded by the following transcript(s): HUMCEA_PEA_1_T26 (SEQ ID NO:113), for which the sequence(s) is/are given at the end of the application. The coding portion of transcript HUMCEA_PEA_1_T26 (SEQ ID NO:113) is shown in bold; this coding portion starts at position 115 and ends at position 1152. The transcript also has the following SNPs as listed in Table 955 (given according to their position on the nucleotide sequence, with the alternative nucleic acid listed; the last column indicates whether the SNP is known or not; the presence of known SNPs in variant protein HUMCEA_PEA_1_P20 (SEQ ID NO:1384) sequence provides support for the deduced sequence of this variant protein according to the present invention).

TABLE 955

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 840 | T -> C | No |
| 894 | C -> T | No |
| 987 | A -> | No |
| 1036 | C -> A | Yes |
| 1090 | G -> | No |
| 1155 | G -> | No |
| 1171 | T -> A | No |
| 1172 | T -> A | No |
| 1364 | G -> A | Yes |
| 1417 | C -> T | No |
| 1928 | A -> G | Yes |
| 2094 | C -> T | Yes |
| 2285 | C -> T | Yes |

As noted above, cluster HUMCEA features 42 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMCEA_PEA_1_node_0 (SEQ ID NO:814) according to the present invention is supported by 56 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111), HUMCEA_PEA_1_T25 (SEQ ID NO:112) and HUMCEA_PEA_1_T26 (SEQ ID NO:113). Table 956 below describes the starting and ending position of this segment on each transcript.

TABLE 956

Segment location on transcripts

| Transcript name | Segment starting position | Segment ending position |
|---|---|---|
| HUMCEA_PEA_1_T8 (SEQ ID NO: 109) | 1 | 178 |
| HUMCEA_PEA_1_T9 (SEQ ID NO: 110) | 1 | 178 |
| HUMCEA_PEA_1_T20 (SEQ ID NO: 111) | 1 | 178 |
| HUMCEA_PEA_1_T25 (SEQ ID NO: 112) | 1 | 178 |
| HUMCEA_PEA_1_T26 (SEQ ID NO: 113) | 1 | 178 |

Segment cluster HUMCEA_PEA_1_node_2 (SEQ ID NO:815) according to the present invention is supported by 83 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:11), HUMCEA_PEA_1_T25 (SEQ ID NO:112) and HUMCEA_PEA_1_T26

(SEQ ID NO:113). Table 957 below describes the starting and ending position of this segment on each transcript.

TABLE 957

Segment location on transcripts

| Transcript name | Segment starting position | Segment ending position |
|---|---|---|
| HUMCEA_PEA_1_T8 (SEQ ID NO: 109) | 179 | 456 |
| HUMCEA_PEA_1_T9 (SEQ ID NO: 110) | 179 | 456 |
| HUMCEA_PEA_1_T20 (SEQ ID NO: 111) | 179 | 456 |
| HUMCEA_PEA_1_T25 (SEQ ID NO: 112) | 179 | 456 |
| HUMCEA_PEA_1_T26 (SEQ ID NO: 113) | 179 | 456 |

Segment cluster HUMCEA_PEA_1_node_11 (SEQ ID NO:816) according to the present invention is supported by 6 libraries. The number of libraries was determined as previously described. This segment can be found in the following transcript(s): HUMCEA_PEA_1_T8 (SEQ ID NO:109). Table 958 below describes the starting and ending position of this segment on each transcript.

TABLE 958

Segment location on transcripts

| Transcript name | Segment starting position | Segment ending position |
|---|---|---|
| HUMCEA_PEA_1_T8 (SEQ ID NO: 109) | 818 | 1217 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 959.

TABLE 959

Oligonucleotides related to this segment

| Oligonucleotide name | Overexpressed in cancers | Chip reference |
|---|---|---|
| HUMCEA_0_0_96 | lung malignant tumors | LUN |

Segment cluster HUMCEA_PEA_1_node_12 (SEQ ID NO:817) according to the present invention is supported by 83 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 960 below describes the starting and ending position of this segment on each transcript.

TABLE 960

Segment location on transcripts

| Transcript name | Segment starting position | Segment ending position |
|---|---|---|
| HUMCEA_PEA_1_T8 (SEQ ID NO: 109) | 1218 | 1472 |

TABLE 960-continued

Segment location on transcripts

| Transcript name | Segment starting position | Segment ending position |
|---|---|---|
| HUMCEA_PEA_1_T9 (SEQ ID NO: 110) | 818 | 1072 |
| HUMCEA_PEA_1_T20 (SEQ ID NO: 111) | 818 | 1072 |

Segment cluster HUMCEA_PEA_1_node_31 (SEQ ID NO:818) according to the present invention is supported by 87 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 961 below describes the starting and ending position of this segment on each transcript.

TABLE 961

Segment location on transcripts

| Transcript name | Segment starting position | Segment ending position |
|---|---|---|
| HUMCEA_PEA_1_T8 (SEQ ID NO: 109) | 1817 | 2006 |
| HUMCEA_PEA_1_T9 (SEQ ID NO: 110) | 1417 | 1606 |
| HUMCEA_PEA_1_T20 (SEQ ID NO: 111) | 1417 | 1606 |

Segment cluster HUMCEA_PEA_1_node_36 (SEQ ID NO:819) according to the present invention is supported by 94 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 962 below describes the starting and ending position of this segment on each transcript.

TABLE 962

Segment location on transcripts

| Transcript name | Segment starting position | Segment ending position |
|---|---|---|
| HUMCEA_PEA_1_T8 (SEQ ID NO: 109) | 2159 | 2285 |
| HUMCEA_PEA_1_T9 (SEQ ID NO: 110) | 1759 | 1885 |
| HUMCEA_PEA_1_T26 (SEQ ID NO: 113) | 691 | 817 |

Segment cluster HUMCEA_PEA_1_node_44 (SEQ ID NO:820) according to the present invention is supported by 112 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T25 (SEQ ID NO:112) and HUMCEA_PEA_1_T26 (SEQ ID NO:113). Table 963 below describes the starting and ending position of this segment on each transcript.

TABLE 963

Segment location on transcripts

| Transcript name | Segment starting position | Segment ending position |
|---|---|---|
| HUMCEA_PEA_1_T8 (SEQ ID NO: 109) | 2286 | 2540 |
| HUMCEA_PEA_1_T9 (SEQ ID NO: 110) | 1886 | 2140 |
| HUMCEA_PEA_1_T25 (SEQ ID NO: 112) | 818 | 1072 |
| HUMCEA_PEA_1_T26 (SEQ ID NO: 113) | 818 | 1072 |

Segment cluster HUMCEA_PEA_1_node_46 (SEQ ID NO:821) according to the present invention is supported by 15 libraries. The number of libraries was determined as previously described. This segment can be found in the following transcript(s): HUMCEA_PEA_1_T9 (SEQ ID NO:110). Table 964 below describes the starting and ending position of this segment on each transcript.

TABLE 964

Segment location on transcripts

| Transcript name | Segment starting position | Segment ending position |
|---|---|---|
| HUMCEA_PEA_1_T9 (SEQ ID NO: 110) | 2174 | 3347 |

Segment cluster HUMCEA_PEA_1_node_63 (SEQ ID NO:822) according to the present invention is supported by 68 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 965 below describes the starting and ending position of this segment on each transcript.

TABLE 965

Segment location on transcripts

| Transcript name | Segment starting position | Segment ending position |
|---|---|---|
| HUMCEA_PEA_1_T8 (SEQ ID NO: 109) | 2957 | 3135 |
| HUMCEA_PEA_1_T25 (SEQ ID NO: 112) | 1489 | 1667 |
| HUMCEA_PEA_1_T26 (SEQ ID NO: 113) | 1489 | 1667 |

Segment cluster HUMCEA_PEA_1_node_65 (SEQ ID NO:823) according to the present invention is supported by 54 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 966 below describes the starting and ending position of this segment on each transcript.

TABLE 966

Segment location on transcripts

| Transcript name | Segment starting position | Segment ending position |
|---|---|---|
| HUMCEA_PEA_1_T8 (SEQ ID NO: 109) | 3166 | 3897 |
| HUMCEA_PEA_1_T25 (SEQ ID NO: 112) | 1698 | 2429 |
| HUMCEA_PEA_1_T26 (SEQ ID NO: 113) | 1698 | 2429 |

Segment cluster HUMCEA_PEA_1_node_67 (SEQ ID NO:824) according to the present invention is supported by 2 libraries. The number of libraries was determined as previously described. This segment can be found in the following transcript(s): HUMCEA_PEA_1_T20 (SEQ ID NO:111). Table 967 below describes the starting and ending position of this segment on each transcript.

TABLE 967

Segment location on transcripts

| Transcript name | Segment starting position | Segment ending position |
|---|---|---|
| HUMCEA_PEA_1_T20 (SEQ ID NO: 111) | 1607 | 1886 |

According to an optional embodiment of the present invention, short segments related to the above cluster are also provided. These segments are up to about 120 bp in length, and so are included in a separate description.

Segment cluster HUMCEA_PEA_1_node_3 (SEQ ID NO:825) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111), HUMCEA_PEA_1_T25 (SEQ ID NO:112) and HUMCEA_PEA_1_T26 (SEQ ID NO:113). Table 968 below describes the starting and ending position of this segment on each transcript.

TABLE 968

Segment location on transcripts

| Transcript name | Segment starting position | Segment ending position |
|---|---|---|
| HUMCEA_PEA_1_T8 (SEQ ID NO: 109) | 457 | 538 |
| HUMCEA_PEA_1_T9 (SEQ ID NO: 110) | 457 | 538 |
| HUMCEA_PEA_1_T20 (SEQ ID NO: 111) | 457 | 538 |
| HUMCEA_PEA_1_T25 (SEQ ID NO: 112) | 457 | 538 |
| HUMCEA_PEA_1_T26 (SEQ ID NO: 113) | 457 | 538 |

Segment cluster HUMCEA_PEA_1_node_7 (SEQ ID NO:826) according to the present invention is supported by 73 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUM- CEA_PEA_1_T25 (SEQ ID NO:112). Table 969 below describes the starting and ending position of this segment on each transcript.

TABLE 969

Segment location on transcripts

| Transcript name | Segment starting position | Segment ending position |
|---|---|---|
| HUMCEA_PEA_1_T8 (SEQ ID NO: 109) | 539 | 642 |
| HUMCEA_PEA_1_T9 (SEQ ID NO: 110) | 539 | 642 |
| HUMCEA_PEA_1_T20 (SEQ ID NO: 111) | 539 | 642 |
| HUMCEA_PEA_1_T25 (SEQ ID NO: 112) | 539 | 642 |

Segment cluster HUMCEA_PEA_1_node_8 (SEQ ID NO:827) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUMCEA_PEA_1_T25 (SEQ ID NO:112). Table 970 below describes the starting and ending position of this segment on each transcript.

TABLE 970

Segment location on transcripts

| Transcript name | Segment starting position | Segment ending position |
|---|---|---|
| HUMCEA_PEA_1_T8 (SEQ ID NO: 109) | 643 | 690 |
| HUMCEA_PEA_1_T9 (SEQ ID NO: 110) | 643 | 690 |
| HUMCEA_PEA_1_T20 (SEQ ID NO: 111) | 643 | 690 |
| HUMCEA_PEA_1_T25 (SEQ ID NO: 112) | 643 | 690 |

Segment cluster HUMCEA_PEA_1_node_9 (SEQ ID NO:828) according to the present invention is supported by 71 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUMCEA_PEA_1_T25 (SEQ ID NO:12). Table 971 below describes the starting and ending position of this segment on each transcript.

TABLE 971

Segment location on transcripts

| Transcript name | Segment starting position | Segment ending position |
|---|---|---|
| HUMCEA_PEA_1_T8 (SEQ ID NO: 109) | 691 | 738 |
| HUMCEA_PEA_1_T9 (SEQ ID NO: 110) | 691 | 738 |
| HUMCEA_PEA_1_T20 (SEQ ID NO: 111) | 691 | 738 |
| HUMCEA_PEA_1_T25 (SEQ ID NO: 112) | 691 | 738 |

TABLE 971-continued

Segment location on transcripts

| Transcript name | Segment starting position | Segment ending position |
|---|---|---|

Segment cluster HUMCEA_PEA_1_node_10 (SEQ ID NO:829) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUMCEA_PEA_1_T25 (SEQ ID NO:112). Table 972 below describes the starting and ending position of this segment on each transcript.

TABLE 972

Segment location on transcripts

| Transcript name | Segment starting position | Segment ending position |
|---|---|---|
| HUMCEA_PEA_1_T8 (SEQ ID NO: 109) | 739 | 817 |
| HUMCEA_PEA_1_T9 (SEQ ID NO: 110) | 739 | 817 |
| HUMCEA_PEA_1_T20 (SEQ ID NO: 111) | 739 | 817 |
| HUMCEA_PEA_1_T25 (SEQ ID NO: 112) | 739 | 817 |

Segment cluster HUMCEA_PEA_1_node_15 (SEQ ID NO:830) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 973 below describes the starting and ending position of this segment on each transcript.

TABLE 973

Segment location on transcripts

| Transcript name | Segment starting position | Segment ending position |
|---|---|---|
| HUMCEA_PEA_1_T8 (SEQ ID NO: 109) | 1473 | 1475 |
| HUMCEA_PEA_1_T9 (SEQ ID NO: 110) | 1073 | 1075 |
| HUMCEA_PEA_1_T20 (SEQ ID NO: 111) | 1073 | 1075 |

Segment cluster HUMCEA_PEA_1_node_16 (SEQ ID NO:831) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 974 below describes the starting and ending position of this segment on each transcript.

TABLE 974

Segment location on transcripts

| Transcript name | Segment starting position | Segment ending position |
|---|---|---|
| HUMCEA_PEA_1_T8 (SEQ ID NO: 109) | 1476 | 1481 |
| HUMCEA_PEA_1_T9 (SEQ ID NO: 110) | 1076 | 1081 |
| HUMCEA_PEA_1_T20 (SEQ ID NO: 111) | 1076 | 1081 |

Segment cluster HUMCEA_PEA_1_node_17 (SEQ ID NO:832) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 975 below describes the starting and ending position of this segment on each transcript.

TABLE 975

Segment location on transcripts

| Transcript name | Segment starting position | Segment ending position |
|---|---|---|
| HUMCEA_PEA_1_T8 (SEQ ID NO: 109) | 1482 | 1488 |
| HUMCEA_PEA_1_T9 (SEQ ID NO: 110) | 1082 | 1088 |
| HUMCEA_PEA_1_T20 (SEQ ID NO: 111) | 1082 | 1088 |

Segment cluster HUMCEA_PEA_1_node_18 (SEQ ID NO:833) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 976 below describes the starting and ending position of this segment on each transcript.

TABLE 976

Segment location on transcripts

| Transcript name | Segment starting position | Segment ending position |
|---|---|---|
| HUMCEA_PEA_1_T8 (SEQ ID NO: 109) | 1489 | 1506 |
| HUMCEA_PEA_1_T9 (SEQ ID NO: 110) | 1089 | 1106 |
| HUMCEA_PEA_1_T20 (SEQ ID NO: 111) | 1089 | 1106 |

Segment cluster HUMCEA_PEA_1_node_19 (SEQ ID NO:834) according to the present invention is supported by 69 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 977 below describes the starting and ending position of this segment on each transcript.

TABLE 977

Segment location on transcripts

| Transcript name | Segment starting position | Segment ending position |
|---|---|---|
| HUMCEA_PEA_1_T8 (SEQ ID NO: 109) | 1507 | 1576 |
| HUMCEA_PEA_1_T9 (SEQ ID NO: 110) | 1107 | 1176 |
| HUMCEA_PEA_1_T20 (SEQ ID NO: 111) | 1107 | 1176 |

Segment cluster HUMCEA_PEA_1_node_20 (SEQ ID NO:835) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 978 below describes the starting and ending position of this segment on each transcript.

TABLE 978

Segment location on transcripts

| Transcript name | Segment starting position | Segment ending position |
|---|---|---|
| HUMCEA_PEA_1_T8 (SEQ ID NO: 109) | 1577 | 1600 |
| HUMCEA_PEA_1_T9 (SEQ ID NO: 110) | 1177 | 1200 |
| HUMCEA_PEA_1_T20 (SEQ ID NO: 111) | 1177 | 1200 |

Segment cluster HUMCEA_PEA_1_node_21 (SEQ ID NO:836) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 979 below describes the starting and ending position of this segment on each transcript.

TABLE 979

Segment location on transcripts

| Transcript name | Segment starting position | Segment ending position |
|---|---|---|
| HUMCEA_PEA_1_T8 (SEQ ID NO: 109) | 1601 | 1624 |
| HUMCEA_PEA_1_T9 (SEQ ID NO: 110) | 1201 | 1224 |
| HUMCEA_PEA_1_T20 (SEQ ID NO: 111) | 1201 | 1224 |

Segment cluster HUMCEA_PEA_1_node_22 (SEQ ID NO:837) according to the present invention is supported by 77 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 980 below describes the starting and ending position of this segment on each transcript.

TABLE 980

Segment location on transcripts

| Transcript name | Segment starting position | Segment ending position |
|---|---|---|
| HUMCEA_PEA_1_T8 (SEQ ID NO: 109) | 1625 | 1702 |
| HUMCEA_PEA_1_T9 (SEQ ID NO: 110) | 1225 | 1302 |
| HUMCEA_PEA_1_T20 (SEQ ID NO: 111) | 1225 | 1302 |

Segment cluster HUMCEA_PEA_1_node_23 (SEQ ID NO:838) according to the present invention is supported by 72 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 981 below describes the starting and ending position of this segment on each transcript.

TABLE 981

Segment location on transcripts

| Transcript name | Segment starting position | Segment ending position |
|---|---|---|
| HUMCEA_PEA_1_T8 (SEQ ID NO: 109) | 1703 | 1732 |
| HUMCEA_PEA_1_T9 (SEQ ID NO: 110) | 1303 | 1332 |
| HUMCEA_PEA_1_T20 (SEQ ID NO: 111) | 1303 | 1332 |

Segment cluster HUMCEA_PEA_1_node_24 (SEQ ID NO:839) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 982 below describes the starting and ending position of this segment on each transcript.

TABLE 982

Segment location on transcripts

| Transcript name | Segment starting position | Segment ending position |
|---|---|---|
| HUMCEA_PEA_1_T8 (SEQ ID NO: 109) | 1733 | 1751 |
| HUMCEA_PEA_1_T9 (SEQ ID NO: 110) | 1333 | 1351 |
| HUMCEA_PEA_1_T20 (SEQ ID NO: 111) | 1333 | 1351 |

Segment cluster HUMCEA_PEA_1_node_27 (SEQ ID NO:840) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 983 below describes the starting and ending position of this segment on each transcript.

TABLE 983

Segment location on transcripts

| Transcript name | Segment starting position | Segment ending position |
|---|---|---|
| HUMCEA_PEA_1_T8 (SEQ ID NO: 109) | 1752 | 1770 |
| HUMCEA_PEA_1_T9 (SEQ ID NO: 110) | 1352 | 1370 |
| HUMCEA_PEA_1_T20 (SEQ ID NO: 111) | 1352 | 1370 |

Segment cluster HUMCEA_PEA_1_node_29 (SEQ ID NO:841) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 984 below describes the starting and ending position of this segment on each transcript.

TABLE 984

Segment location on transcripts

| Transcript name | Segment starting position | Segment ending position |
|---|---|---|
| HUMCEA_PEA_1_T8 (SEQ ID NO: 109) | 1771 | 1788 |
| HUMCEA_PEA_1_T9 (SEQ ID NO: 110) | 1371 | 1388 |
| HUMCEA_PEA_1_T20 (SEQ ID NO: 111) | 1371 | 1388 |

Segment cluster HUMCEA_PEA_1_node_30 (SEQ ID NO:842) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 985 below describes the starting and ending position of this segment on each transcript.

TABLE 985

Segment location on transcripts

| Transcript name | Segment starting position | Segment ending position |
|---|---|---|
| HUMCEA_PEA_1_T8 (SEQ ID NO: 109) | 1789 | 1816 |
| HUMCEA_PEA_1_T9 (SEQ ID NO: 110) | 1389 | 1416 |
| HUMCEA_PEA_1_T20 (SEQ ID NO: 111) | 1389 | 1416 |

Segment cluster HUMCEA_PEA_1_node_33 (SEQ ID NO:843) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 986 below describes the starting and ending position of this segment on each transcript.

TABLE 986

Segment location on transcripts

| Transcript name | Segment starting position | Segment ending position |
|---|---|---|
| HUMCEA_PEA_1_T8 (SEQ ID NO: 109) | 2007 | 2028 |
| HUMCEA_PEA_1_T9 (SEQ ID NO: 110) | 1607 | 1628 |
| HUMCEA_PEA_1_T26 (SEQ ID NO: 113) | 539 | 560 |

Segment cluster HUMCEA_PEA_1_node_34 (SEQ ID NO:844) according to the present invention is supported by 80 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 987 below describes the starting and ending position of this segment on each transcript.

TABLE 987

Segment location on transcripts

| Transcript name | Segment starting position | Segment ending position |
|---|---|---|
| HUMCEA_PEA_1_T8 (SEQ ID NO: 109) | 2029 | 2110 |
| HUMCEA_PEA_1_T9 (SEQ ID NO: 110) | 1629 | 1710 |
| HUMCEA_PEA_1_T26 (SEQ ID NO: 113) | 561 | 642 |

Segment cluster HUMCEA_PEA_1_node_35 (SEQ ID NO:845) according to the present invention is supported by 75 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 988 below describes the starting and ending position of this segment on each transcript.

TABLE 988

Segment location on transcripts

| Transcript name | Segment starting position | Segment ending position |
|---|---|---|
| HUMCEA_PEA_1_T8 (SEQ ID NO: 109) | 2111 | 2158 |
| HUMCEA_PEA_1_T9 (SEQ ID NO: 110) | 1711 | 1758 |
| HUMCEA_PEA_1_T26 (SEQ ID NO: 113) | 643 | 690 |

Segment cluster HUMCEA_PEA_1_node_45 (SEQ ID NO:846) according to the present invention is supported by 9 libraries. The number of libraries was determined as previously described. This segment can be found in the following transcript(s): HUMCEA_PEA_1_T9 (SEQ ID NO:110). Table 989 below describes the starting and ending position of this segment on each transcript.

TABLE 989

Segment location on transcripts

| Transcript name | Segment starting position | Segment ending position |
|---|---|---|
| HUMCEA_PEA_1_T9 (SEQ ID NO: 110) | 2141 | 2173 |

Segment cluster HUMCEA_PEA_1_node_50 (SEQ ID NO:847) according to the present invention is supported by 64 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 990 below describes the starting and ending position of this segment on each transcript.

TABLE 990

Segment location on transcripts

| Transcript name | Segment starting position | Segment ending position |
|---|---|---|
| HUMCEA_PEA_1_T8 (SEQ ID NO: 109) | 2541 | 2567 |
| HUMCEA_PEA_1_T25 (SEQ ID NO: 112) | 1073 | 1099 |
| HUMCEA_PEA_1_T26 (SEQ ID NO: 113) | 1073 | 1099 |

Segment cluster HUMCEA_PEA_1_node_51 (SEQ ID NO:848) according to the present invention is supported by 88 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 991 below describes the starting and ending position of this segment on each transcript.

TABLE 991

Segment location on transcripts

| Transcript name | Segment starting position | Segment ending position |
|---|---|---|
| HUMCEA_PEA_1_T8 (SEQ ID NO: 109) | 2568 | 2659 |
| HUMCEA_PEA_1_T25 (SEQ ID NO: 112) | 1100 | 1191 |
| HUMCEA_PEA_1_T26 (SEQ ID NO: 113) | 1100 | 1191 |

Segment cluster HUMCEA_PEA_1_node_56 (SEQ ID NO:849) according to the present invention is supported by 75 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:13). Table 992 below describes the starting and ending position of this segment on each transcript.

TABLE 992

Segment location on transcripts

| Transcript name | Segment starting position | Segment ending position |
|---|---|---|
| HUMCEA_PEA_1_T8 (SEQ ID NO: 109) | 2660 | 2685 |
| HUMCEA_PEA_1_T25 (SEQ ID NO: 112) | 1192 | 1217 |
| HUMCEA_PEA_1_T26 (SEQ ID NO: 113) | 1192 | 1217 |

Segment cluster HUMCEA_PEA_1_node_57 (SEQ ID NO:850) according to the present invention is supported by 82 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 993 below describes the starting and ending position of this segment on each transcript.

TABLE 993

Segment location on transcripts

| Transcript name | Segment starting position | Segment ending position |
|---|---|---|
| HUMCEA_PEA_1_T8 (SEQ ID NO: 109) | 2686 | 2786 |
| HUMCEA_PEA_1_T25 (SEQ ID NO: 112) | 1218 | 1318 |
| HUMCEA_PEA_1_T26 (SEQ ID NO: 113) | 1218 | 1318 |

Segment cluster HUMCEA_PEA_1_node_58 (SEQ ID NO:851) according to the present invention is supported by 63 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 994 below describes the starting and ending position of this segment on each transcript.

TABLE 994

Segment location on transcripts

| Transcript name | Segment starting position | Segment ending position |
|---|---|---|
| HUMCEA_PEA_1_T8 (SEQ ID NO: 109) | 2787 | 2820 |
| HUMCEA_PEA_1_T25 (SEQ ID NO: 112) | 1319 | 1352 |
| HUMCEA_PEA_1_T26 (SEQ ID NO: 113) | 1319 | 1352 |

Segment cluster HUMCEA_PEA_1_node_60 (SEQ ID NO:852) according to the present invention is supported by 55 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 995 below describes the starting and ending position of this segment on each transcript.

TABLE 995

Segment location on transcripts

| Transcript name | Segment starting position | Segment ending position |
|---|---|---|
| HUMCEA_PEA_1_T8 (SEQ ID NO: 109) | 2821 | 2864 |
| HUMCEA_PEA_1_T25 (SEQ ID NO: 112) | 1353 | 1396 |
| HUMCEA_PEA_1_T26 (SEQ ID NO: 113) | 1353 | 1396 |

Segment cluster HUMCEA_PEA_1_node_61 (SEQ ID NO:853) according to the present invention can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 996 below describes the starting and ending position of this segment on each transcript.

TABLE 996

Segment location on transcripts

| Transcript name | Segment starting position | Segment ending position |
|---|---|---|
| HUMCEA_PEA_1_T8 (SEQ ID NO: 109) | 2865 | 2868 |
| HUMCEA_PEA_1_T25 (SEQ ID NO: 112) | 1397 | 1400 |
| HUMCEA_PEA_1_T26 (SEQ ID NO: 113) | 1397 | 1400 |

Segment cluster HUMCEA_PEA_1_node_62 (SEQ ID NO:854) according to the present invention is supported by 60 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 997 below describes the starting and ending position of this segment on each transcript.

TABLE 997

Segment location on transcripts

| Transcript name | Segment starting position | Segment ending position |
|---|---|---|
| HUMCEA_PEA_1_T8 (SEQ ID NO: 109) | 2869 | 2956 |
| HUMCEA_PEA_1_T25 (SEQ ID NO: 112) | 1401 | 1488 |
| HUMCEA_PEA_1_T26 (SEQ ID NO: 113) | 1401 | 1488 |

Segment cluster HUMCEA_PEA_1_node_64 (SEQ ID NO:855) according to the present invention is supported by 45 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 998 below describes the starting and ending position of this segment on each transcript.

TABLE 998

Segment location on transcripts

| Transcript name | Segment starting position | Segment ending position |
|---|---|---|
| HUMCEA_PEA_1_T8 (SEQ ID NO: 109) | 3136 | 3165 |
| HUMCEA_PEA_1_T25 (SEQ ID NO: 112) | 1668 | 1697 |
| HUMCEA_PEA_1_T26 (SEQ ID NO: 113) | 1668 | 1697 |

Variant Protein Alignment to the Previously Known Protein:
Sequence name: CEA5_HUMAN (SEQ ID NO:1451)
Sequence documentation:
Alignment of: HUMCEA_PEA_1_P4 (SEQ ID NO:1380) x CEA5_HUMAN (SEQ ID NO:1451) ..
Alignment segment 1/1:

| | | | |
|---|---|---|---|
| Quality: | 2320.00 | Escore: | 0 |
| Matching length: | 234 | Total length: | 234 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MESPSAPPHRWCIPWQRLLLTASLLTFWNPPTTAKLTIESTPFNVAEGKE  50
    ||||||||||||||||||||||||||||||||||||||||||| ||||||
  1 MESPSAPPHRWCIPWQRLLLTASLLTFWNPPTTAKLTIESTPVNVAEGKE  50

51 VLLLVHNLPQHLFGYSWYKGERVDGNRQIIGYVIGTQQATPGPAYSGREI 100
    ||||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200

201 TLFNVTRNDTASYKCETQNPVSARRSDSVILNVL              234
    |||||||||||||||||||||||||||||||||||
201 TLFNVTRNDTASYKCETQNPVSARRSDSVILNVL              234
```

Sequence name: CEA5_HUMAN (SEQ ID NO:1451)
Sequence documentation:
Alignment of: HUMCEA_PEA_1_P5 (SEQ ID NO:1381) x CEA5_HUMAN (SEQ ID NO:1451) ..
Alignment segment 1/1:

| | | | |
|---|---|---|---|
| Quality: | 6692.00 | Escore: | 0 |
| Matching length: | 675 | Total length: | 675 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MESPSAPPHRWCIPWQRLLLTASLLTFWNPPTTAKLTIESTPFNVAEGKE  50
    ||||||||||||||||||||||||||||||||||||||||||| ||||||
  1 MESPSAPPHRWCIPWQRLLLTASLLTFWNPPTTAKLTIESTPVNVAEGKE  50

51 VLLLVHNLPQHLFGYSWYKGERVDGNRQIIGYVIGTQQATPGPAYSGREI 100
    ||||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200
```

-continued

```
201 TLFNVTRNDTASYKCETQNPVSARRSDSVILNVLYGPDAPTISPLNTSYR 250
    ||||||||||||||||||||||||||||||||||||||||||||||||||
201 TLFNVTRNDTASYKCETQNPVSARRSDSVILNVLYGPDAPTISPLNTSYR 250

251 SGENLNLSCHAASNPPAQYSWFVNGTFQQSTQELFIPNITVNNSGSYTCQ 300
    ||||||||||||||||||||||||||||||||||||||||||||||||||
251 SGENLNLSCHAASNPPAQYSWFVNGTFQQSTQELFIPNITVNNSGSYTCQ 300

301 AHNSDTGLNRTTVTTITVYAEPPKPFITSNNSNPVEDEDAVALTCEPEIQ 350
    ||||||||||||||||||||||||||||||||||||||||||||||||||
301 AHNSDTGLNRTTVTTITVYAEPPKPFITSNNSNPVEDEDAVALTCEPEIQ 350

351 NTTYLWWVNNQSLPVSPRLQLSNDNRTLTLLSVTRNDVGPYECGIQNELS 400
    ||||||||||||||||||||||||||||||||||||||||||||||||||
351 NTTYLWWVNNQSLPVSPRLQLSNDNRTLTLLSVTRNDVGPYECGIQNELS 400

401 VDHSDPVILNVLYGPDDPTISPSYTYYRPGVNLSLSCHAASNPPAQYSWL 450
    ||||||||||||||||||||||||||||||||||||||||||||||||||
401 VDHSDPVILNVLYGPDDPTISPSYTYYRPGVNLSLSCHAASNPPAQYSWL 450

451 IDGNIQQHTQELFISNITEKNSGLYTCQANNSASGHSRTTVKTITVSAEL 500
    ||||||||||||||||||||||||||||||||||||||||||||||||||
451 IDGNIQQHTQELFISNITEKNSGLYTCQANNSASGHSRTTVKTITVSAEL 500

501 PKPSISSNNSKPVEDKDAVAFTCEPEAQNTTYLWWVNGQSLPVSPRLQLS 550
    ||||||||||||||||||||||||||||||||||||||||||||||||||
501 PKPSISSNNSKPVEDKDAVAFTCEPEAQNTTYLWWVNGQSLPVSPRLQLS 550

551 NGNRTLTLFNVTRNDARAYVCGIQNSVSANRSDPVTLDVLYGPDTPIISP 600
    ||||||||||||||||||||||||||||||||||||||||||||||||||
551 NGNRTLTLFNVTRNDARAYVCGIQNSVSANRSDPVTLDVLYGPDTPIISP 600

601 PDSSYLSGANLNLSCHSASNPSPQYSWRINGIPQQHTQVLFIAKITPNNN 650
    ||||||||||||||||||||||||||||||||||||||||||||||||||
601 PDSSYLSGANLNLSCHSASNPSPQYSWRINGIPQQHTQVLFIAKITPNNN 650

651 GTYACFVSNLATGRNNSIVKSITVS               675
    |||||||||||||||||||||||||
651 GTYACFVSNLATGRNNSIVKSITVS               675
```

Sequence name: CEA5_HUMAN (SEQ ID NO:1451)
Sequence documentation:
Alignment of: HUMCEA_PEA__1_P19 (SEQ ID NO:1383)
    x CEA5_HUMAN (SEQ ID NO:1451) ..
Alignment segment 1/1:

| | | | |
|---|---|---|---|
| Quality: | 3298.00 | Escore: | 0 |
| Matching length: | 346 | Total length: | 702 |
| Matching Percent Similarity: | 100.00 | Matching Percent Identity: | 100.00 |
| Total Percent Similarity: | 49.29 | Total Percent Identity: | 49.29 |
| Gaps: | 1 | | |

Alignment:

```
  1 MESPSAPPHRWCIPWQRLLLTASLLTFWNPPTTAKLTIESTPFNVAEGKE 50
    ||||||||||||||||||||||||||||||||||||||||||||||||||
  1 MESPSAPPHRWCIPWQRLLLTASLLTFWNPPTTAKLTIESTPFNVAEGKE 50

51 VLLLVHNLPQHLFGYSWYKGERVDGNRQIIGYVIGTQQATPGPAYSGREI 100
    ||||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200
```

-continued

```
201 TLFNVTRNDTASYKCETQNPVSARRSDVILN................ 232
    |||||||||||||||||||||||||||||||
201 TLFNVTRNDTASYKCETQNPVSARRSDVILNVLYGPDAPTISPLNTSYR 250

232 ................................................ 232

251 SGENLNLSCHAASNPPAQYSWFVNGTFQQSTQELFIPNITVNNSGSYTCQ 300

232 ................................................ 232

301 AHNSDTGLNRTTVTTITVYAEPPKPFITSNNSNPVEDEDAVALTCEPEIQ 350

232 ................................................ 232

351 NTTYLWWVNNQSLPVSPRLQLSNDNRTLTLLSVTRNDVGPYECGIQNELS 400

232 ................................................ 232

401 VDHSDPVILNVLYGPDDPTISPSYTYYRPGVNLSLSCHAASNPPAQYSWL 450

232 ................................................ 232

451 IDGNIQQHTQELFISNITEKNSGLYTCQANNSASGHSRTTVKTITVSAEL 500

232 ................................................ 232

501 PKPSISSNNSKPVEDKDAVAFTCEPEAQNTTYLWWVNGQSLPVSPRLQLS 550

233 ..........................................VLYGPDTPIISP 244
                                              ||||||||||||
551 NGNRTLTLFNVTRNDARAYVCGIQNSVSANRSDPVTLDVLYGPDTPIISP 600

245 PDSSYLSGANLNLSCHSASNPSPQYSWRINGIPQQHTQVLFIAKITPNNN 294
    |||||||||||||||||||||||||||||||||||||||||||||||||
601 PDSSYLSGANLNLSCHSASNPSPQYSWRINGIPQQHTQVLFIAKITPNNN 650

295 GTYACFVSNLATGRNNSIVKSITVSASGTSPGLSAGATVGIMIGVLVGVA 344
    |||||||||||||||||||||||||||||||||||||||||||||||||
651 GTYACFVSNLATGRNNSIVKSITVSASGTSPGLSAGATVGIMIGVLVGVA 700

345 LI 346
    ||
701 LI 702
```

Sequence name: CEA5_HUMAN (SEQ ID NO:1451)
Sequence documentation:
Alignment of: HUMCEA_PEA_1_P20 (SEQ ID NO:1384)
   x CEA5_HUMAN (SEQ ID NO:1451) ..
Alignment segment 1/1:

| | | | |
|---|---|---|---|
| Quality: | 3294.00 | Escore: | 0 |
| Matching length: | 346 | Total length: | 702 |
| Matching Percent Similarity: | 100.00 | Matching Percent Identity: | 100.00 |
| Total Percent Similarity: | 49.29 | Total Percent Identity: | 49.29 |
| Gaps: | 1 | | |

Alignment:

```
  1 MESPSAPPHRWCIPWQRLLLTASLLTFWNPPTTAKLTIESTPFNVAEGKE 50
    |||||||||||||||||||||||||||||||||||||||||||||||||
  1 MESPSAPPHRWCIPWQRLLLTASLLTFWNPPTTAKLTIESTPFNVAEGKE 50

51 VLLLVHNLPQHLFGYSWYKGERVDGNRQIIGYVIGTQQATPGPAYSGREI 100
    |||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYP........ 142
    |||||||||||||||||||||||||||||||||||||||||
101 IYPNASLLIQNIIQNDTGFYTLHVIKSDLVNEEATGQFRVYPELPKPSIS 150
```

-continued

```
142 .............................................. 142

151 SNNSKPVEDKDAVAFTCEPETQDATYLWWVNNQSLPVSPRLQLSNGNRTL 200

142 .............................................. 142

201 TLFNVTRNDTASYKCETQNPVSARRSDSVILNVLYGPDAPTISPLNTSYR 250

142 .............................................. 142

251 SGENLNLSCHAASNPPAQYSWFVNGTFQQSTQELFIPNITVNNSGSYTCQ 300

142 .............................................. 142

301 AHNSDTGLNRTTVTTITVYAEPPKPFITSNNSNPVEDEDAVALTCEPEIQ 350

142 .............................................. 142

351 NTTYLWWVNNQSLPVSPRLQLSNDNRTLTLLSVTRNDVGPYECGIQNELS 400

142 .............................................. 142

401 VDHSDPVILNVLYGPDDPTISPSYTYYRPGVNLSLSCHAASNPPAQYSWL 450

143 ...........................................EL 144
                                                ||
451 IDGNIQQHTQELFISNITEKNSGLYTCQANNSASGHSRTTVKTITVSAEL 500

145 PKPSISSNNSKPVEDKDAVAFTCEPEAQNTTYLWWVNGQSLPVSPRLQLS 194
    ||||||||||||||||||||||||||||||||||||||||||||||||||
501 PKPSISSNNSKPVEDKDAVAFTCEPEAQNTTYLWWVNGQSLPVSPRLQLS 550

195 NGNRTLTLFNVTRNDARAYVCGIQNSVSANRSDPVTLDVLYGPDTPIISP 244
    ||||||||||||||||||||||||||||||||||||||||||||||||||
551 NGNRTLTLFNVTRNDARAYVCGIQNSVSANRSDPVTLDVLYGPDTPIISP 600

245 PDSSYLSGANLNLSCHSASNPSPQYSWRINGIPQQHTQVLFIAKITPNNN 294
    ||||||||||||||||||||||||||||||||||||||||||||||||||
601 PDSSYLSGANLNLSCHSASNPSPQYSWRINGIPQQHTQVLFIAKITPNNN 650

295 GTYACFVSNLATGRNNSIVKSITVSASGTSPGLSAGATVGIMIGVLVGVA 344
    ||||||||||||||||||||||||||||||||||||||||||||||||||
651 GTYACFVSNLATGRNNSIVKSITVSASGTSPGLSAGATVGIMIGVLVGVA 700

345 LI                                                346
    ||
701 LI                                                702
```

Description for Cluster R35137

Cluster R35137 features 6 transcript(s) and 20 segment(s) of interest, the names for which are given in Tables 999 and 1000, respectively, the sequences themselves are given at the end of the application. The selected protein variants are given in table 1001.

TABLE 999

Transcripts of interest

| Transcript Name | Sequence ID No. |
|---|---|
| R35137_PEA_1_PEA_1_PEA_1_T3 | 114 |
| R35137_PEA_1_PEA_1_PEA_1_T5 | 115 |
| R35137_PEA_1_PEA_1_PEA_1_T10 | 116 |
| R35137_PEA_1_PEA_1_PEA_1_T11 | 117 |
| R35137_PEA_1_PEA_1_PEA_1_T12 | 118 |
| R35137_PEA_1_PEA_1_PEA_1_T14 | 119 |

TABLE 1000

Segments of interest

| Segment Name | Sequence ID No. |
|---|---|
| R35137_PEA_1_PEA_1_PEA_1_node_2 | 856 |
| R35137_PEA_1_PEA_1_PEA_1_node_3 | 857 |
| R35137_PEA_1_PEA_1_PEA_1_node_9 | 858 |
| R35137_PEA_1_PEA_1_PEA_1_node_11 | 859 |
| R35137_PEA_1_PEA_1_PEA_1_node_16 | 860 |
| R35137_PEA_1_PEA_1_PEA_1_node_18 | 861 |
| R35137_PEA_1_PEA_1_PEA_1_node_20 | 862 |
| R35137_PEA_1_PEA_1_PEA_1_node_27 | 863 |
| R35137_PEA_1_PEA_1_PEA_1_node_5 | 864 |
| R35137_PEA_1_PEA_1_PEA_1_node_7 | 865 |
| R35137_PEA_1_PEA_1_PEA_1_node_12 | 866 |
| R35137_PEA_1_PEA_1_PEA_1_node_14 | 867 |
| R35137_PEA_1_PEA_1_PEA_1_node_15 | 868 |
| R35137_PEA_1_PEA_1_PEA_1_node_17 | 869 |
| R35137_PEA_1_PEA_1_PEA_1_node_21 | 870 |
| R35137_PEA_1_PEA_1_PEA_1_node_22 | 871 |
| R35137_PEA_1_PEA_1_PEA_1_node_23 | 872 |
| R35137_PEA_1_PEA_1_PEA_1_node_24 | 873 |
| R35137_PEA_1_PEA_1_PEA_1_node_25 | 874 |
| R35137_PEA_1_PEA_1_PEA_1_node_26 | 875 |

TABLE 1001

Proteins of interest

| Protein Name | Sequence ID No. | Corresponding Transcript(s) |
|---|---|---|
| R35137_PEA_1_PEA_1_PEA_1_P9 | 1385 | R35137_PEA_1_PEA_1_PEA_1_T10 (SEQ ID NO: 116); R35137_PEA_1_PEA_1_PEA_1_T12 (SEQ ID NO: 118) |
| R35137_PEA_1_PEA_1_PEA_1_P8 | 1386 | R35137_PEA_1_PEA_1_PEA_1_T11 (SEQ ID NO: 117) |
| R35137_PEA_1_PEA_1_PEA_1_P11 | 1387 | R35137_PEA_1_PEA_1_PEA_1_T14 (SEQ ID NO: 119) |
| R35137_PEA_1_PEA_1_PEA_1_P2 | 1388 | R35137_PEA_1_PEA_1_PEA_1_T3 (SEQ ID NO: 114) |
| R35137_PEA_1_PEA_1_PEA_1_P4 | 1389 | R35137_PEA_1_PEA_1_PEA_1_T5 (SEQ ID NO: 115) |

These sequences are variants of the known protein Alanine aminotransferase (SwissProt accession identifier ALAT_HUMAN; known also according to the synonyms EC 2.6.1.2; Glutamic—pyruvic transaminase; GPT; Glutamic—alanine transaminase), SEQ ID NO:1452, referred to herein as the previously known protein.

Protein Alanine aminotransferase (SEQ ID NO:1452) is known or believed to have the following function(s): Participates in cellular nitrogen metabolism and also in liver gluconeogenesis starting with precursors transported from skeletal muscles. The sequence for protein Alanine aminotransferase is given at the end of the application, as "Alanine aminotransferase amino acid sequence". Known polymorphisms for this sequence are as shown in Table 1002.

TABLE 1002

Amino acid mutations for Known Protein

| SNP position(s) on amino acid sequence | Comment |
|---|---|
| 13 | H -> N (in allele GPT*2; dbSNP: 1063739)./ FTId = VAR_000561. |
| 3-6 | STGD -> RRGN |
| 38 | G -> S |
| 221 | A -> H |

Protein Alanine aminotransferase (SEQ ID NO:1452) localization is believed to be Cytoplasmic.

Cluster R35137 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 34 refer to weighted expression of ESTs in each category, as "parts per million" (ratio of the expression of ESTs for a particular cluster to the expression of all ESTs in that category, according to parts per million).

Figure 34:
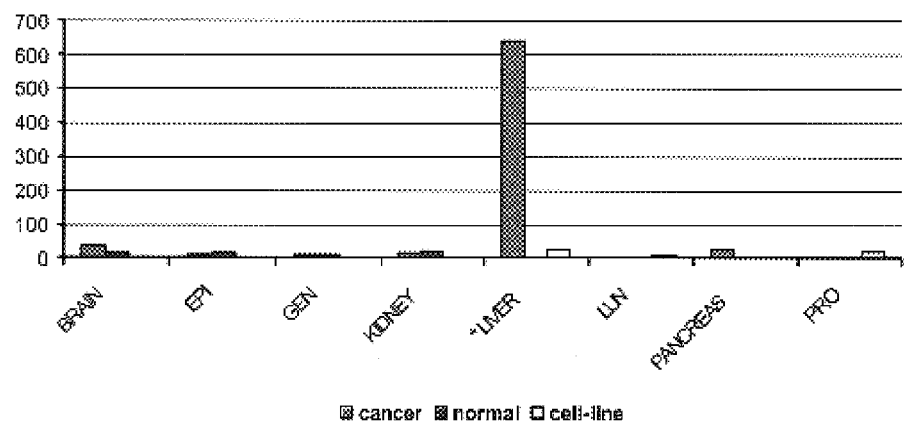
FIG. 34 is a histogram showing Cancer and cell-line vs. normal tissue expression for Cluster R35137, demonstrating overexpression in hepatocellular carcinoma.

Overall, the following results were obtained as shown with regard to the histograms in FIG. 34 and Table 1003. This cluster is overexpressed (at least at a minimum level) in the following pathological conditions: hepatocellular carcinoma.

TABLE 1003

Normal tissue distribution

| Name of Tissue | Number |
|---|---|
| brain | 12 |
| epithelial | 16 |
| general | 8 |
| kidney | 20 |
| liver | 0 |
| lung | 0 |
| pancreas | 2 |
| prostate | 0 |

TABLE 1004

P values and ratios for expression in cancerous tissue

| Name of Tissue | P1 | P2 | SP1 | R3 | SP2 | R4 |
|---|---|---|---|---|---|---|
| brain | 3.2e-01 | 4.8e-01 | 1.8e-01 | 2.5 | 4.2e-01 | 1.5 |
| epithelial | 7.6e-01 | 7.7e-01 | 8.9e-01 | 0.5 | 9.8e-01 | 0.4 |
| general | 6.7e-01 | 8.2e-01 | 4.2e-01 | 1.0 | 8.5e-01 | 0.7 |
| kidney | 8.6e-01 | 9.0e-01 | 5.8e-01 | 0.9 | 7.0e-01 | 0.8 |
| liver | 1.8e-01 | 4.5e-01 | 3.0e-03 | 7.6 | 1.6e-01 | 2.3 |
| lung | 1 | 6.3e-01 | 1 | 1.0 | 6.2e-01 | 1.6 |
| pancreas | 2.3e-01 | 4.0e-01 | 1.8e-01 | 3.1 | 2.8e-01 | 2.3 |
| prostate | 1 | 7.8e-01 | 1 | 1.0 | 7.5e-01 | 1.3 |

As noted above, cluster R35137 features 6 transcript(s), which were listed in Table 1 above. These transcript(s) encode for protein(s) which are variant(s) of protein Alanine aminotransferase (SEQ ID NO:1452). A description of each variant protein according to the present invention is now provided.

Variant protein R35137_PEA_1_PEA_1_PEA_1_P9 (SEQ ID NO:1385) according to the present invention has an amino acid sequence as given at the end of the application; it is encoded by transcript(s) R35137_PEA_1_PEA_1_PEA_1_T10 (SEQ ID NO:116). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison Report Between R35137_PEA_1_PEA_1_PEA_1_P9 (SEQ ID NO:1385) and ALAT_HUMAN_V1 (SEQ ID NO:1453):

1. An isolated chimeric polypeptide encoding for R35137_PEA_1_PEA_1_PEA_1_P9 (SEQ ID NO:1385), comprising a first amino acid sequence being at least 90% homologous to MASSTGDRSQAVRHGLRAKVLTLDG-MNPRVRRVEYAVRGPIVQRALELEQELRQGVK KPFTEVIRANIGDAQAMGQRPITFLRQV-LALCVNPDLLSSPNFPDDAKKRAERILQACG GHSL-GAYSVSSGIQLIREDVARYIERRDGGI-PADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEV corresponding to amino acids 1-274 of ALAT_HUMAN_V1 (SEQ ID NO:1453), which also corresponds to amino acids 1-274 of R35137_PEA_1_PEA_1_PEA_1_P9 (SEQ ID NO:1385), and a second amino acid sequence being at least 70%, optionally at least 80%, preferably at least 85%, more preferably at least 90% and most preferably at least 95% homologous to a polypeptide having the sequence RGAGEREAGQQSAPVTP-CALPGVPGQRVRRGFAVPLIQEGAHGD-GAALRRAAGACLLP LHLQGLHGRVRA-YEAGGGSRAMARPSSPDGPPPPPHLTWPCAGAGS AAAMWRW (SEQ ID NO:1737) corresponding to amino acids 275-385 of R35137_PEA_1_PEA_1_PEA_1_P9 (SEQ ID NO:1385), wherein said first amino acid sequence and second amino acid sequence are contiguous and in a sequential order.

2. An isolated polypeptide encoding for a tail of R35137_PEA_1_PEA_1_PEA_1_P9 (SEQ ID NO:1385), comprising a polypeptide being at least 70%, optionally at least about 80%, preferably at least about 85%, more preferably at least about 90% and most preferably at least about 95% homologous to the sequence RGAGEREAGQQSAPVTP-CALPGVPGQRVRRGFAVPLIQEGAHGD-GAALRRAAGACLLP LHLQGLHGRVRA-YEAGGGSRAMARPSSPDGPPPPPHLTWPCAGAGSA AAMWRW (SEQ ID NO:1737) in R35137_PEA_1_PEA_1_PEA_1_P9 (SEQ ID NO:1385).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 1005

| Changes to ALAT_HUMAN_V1 (SEQ ID NO: 1453) | |
|---|---|
| SNP position(s) on amino acid sequence | Type of change |
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P9 (SEQ ID NO:1385) is encoded by the following transcript(s): R35137_PEA_1_PEA_1_PEA_1_T10 (SEQ ID NO:116), for which the sequence(s) is/are given at the end of the application. The coding portion of transcript R35137_PEA_1_PEA_1_PEA_1_T10 (SEQ ID NO:116) is shown in bold; this coding portion starts at position 271 and ends at position 1425. The transcript also has the following SNPs as listed in Table 1006 (given according to their position on the nucleotide sequence, with the alternative nucleic acid listed; the last column indicates whether the SNP is known or not; the presence of known SNPs in variant protein R35137_PEA_1_PEA_1_PEA_1_P9 (SEQ ID NO:1385) sequence provides support for the deduced sequence of this variant protein according to the present invention).

TABLE 1006

| Nucleic acid SNPs | | |
|---|---|---|
| SNP position on nucleotide sequence | Alternative nucleic acid | Previously known SNP? |
| 230 | C -> T | No |
| 231 | C -> T | No |
| 310 | C -> A | Yes |
| 432 | G -> | No |
| 969 | C -> | No |
| 1225 | G -> | No |
| 1745 | T -> G | No |
| 1957 | C -> | No |
| 2018 | G -> A | No |
| 2019 | C -> A | No |
| 2101 | A -> G | No |
| 2102 | A -> G | No |
| 2159 | C -> T | Yes |
| 2710 | G -> C | No |
| 2789 | C -> A | Yes |
| 3622 | G -> A | Yes |

Variant protein R35137_PEA_1_PEA_1_PEA_1_P8 (SEQ ID NO:1386) according to the present invention has an amino acid sequence as given at the end of the application; it is encoded by transcript(s) R35137_PEA_1_PEA_1_PEA_1_T11 (SEQ ID NO:117). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison Report Between R35137_PEA_1_PEA_1_PEA_1_P8 (SEQ ID NO:1386) and ALAT_HUMAN_V1 (SEQ ID NO:1453):

1. An isolated chimeric polypeptide encoding for R35137_PEA_1_PEA_1_PEA_1_P8 (SEQ ID NO:1386), comprising a first amino acid sequence being at least 90% homologous to MASSTGDRSQAVRHGLRAKVLTLDG-MNPRVRRVEYAVRGPIVQRALELEQELRQGVK KPFTEVIRANIGDAQAMGQRPITFLRQV-LALCVNPDLLSSPNFPDDAKKRAERILQACG GHSL-GAYSVSSGIQLIREDVARYIERRDGGI-PADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEVYQDNVYAAGSQFHSFKKVL MEMG-PPYAGQQELASFHSTSKGYMGEC corresponding to amino acids 1-320 of ALAT_HUMAN_V1 (SEQ ID NO:1453), which also corresponds to amino acids 1-320 of R35137_PEA_1_PEA_1_PEA_1_P8 (SEQ ID NO:1386), and a second amino acid sequence being at least 70%, optionally at least 80%, preferably at least 85%, more preferably at least 90% and most preferably at least 95% homologous to a polypeptide having the sequence VRTRRVGARGPWPGP-PRPMGHPLLRT (SEQ ID NO:1738) corresponding to amino acids 321-346 of R35137_PEA_1_PEA_1_PEA_1_P8 (SEQ ID NO:1386), wherein said first amino acid sequence and second amino acid sequence are contiguous and in a sequential order.

2. An isolated polypeptide encoding for a tail of R35137_PEA_1_PEA_1_PEA_1_P8 (SEQ ID NO:1386), comprising a polypeptide being at least 70%, optionally at least about 80%, preferably at least about 85%, more preferably at least about 90% and most preferably at least about 95% homologous to the sequence VRTRRVGARGPWPGP-PRPMGHPLLRT (SEQ ID NO:1738) in R35137_PEA_1_PEA_1_PEA_1_P8 (SEQ ID NO:1386).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 1007

Changes to ALAT_HUMAN_V1 (SEQ ID NO: 1453)

| SNP position(s) on amino acid sequence | Type of change |
| --- | --- |
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P8 (SEQ ID NO:1386) also has the following non-silent SNPs (Single Nucleotide Polymorphisms) as listed in Table 1008, (given according to their position(s) on the amino acid sequence, with the alternative amino acid(s) listed; the last column indicates whether the SNP is known or not; the presence of known SNPs in variant protein R35137_PEA_1_PEA_1_PEA_1_P8 (SEQ ID NO:1386) sequence provides support for the deduced sequence of this variant protein according to the present invention).

TABLE 1008

Amino acid mutations

| SNP position(s) on amino acid sequence | Alternative amino acid(s) | Previously known SNP? |
| --- | --- | --- |
| 14 | H -> N | Yes |
| 54 | Q -> | No |
| 233 | R -> | No |
| 296 | M -> | No |

Variant protein R35137_PEA_1_PEA_1_PEA_1_P8 (SEQ ID NO:1386) is encoded by the following transcript(s): R35137_PEA_1_PEA_1_PEA_1_T11 (SEQ ID NO:117), for which the sequence(s) is/are given at the end of the application. The coding portion of transcript R35137_PEA_1_PEA_1_PEA_1_T11 (SEQ ID NO:117) is shown in bold; this coding portion starts at position 271 and ends at position 1308. The transcript also has the following SNPs as listed in Table 1009 (given according to their position on the nucleotide sequence, with the alternative nucleic acid listed; the last column indicates whether the SNP is known or not; the presence of known SNPs in variant protein R35137_PEA_1_PEA_1_PEA_1_P8 (SEQ ID NO:1386) sequence provides support for the deduced sequence of this variant protein according to the present invention).

TABLE 1009

Nucleic acid SNPs

| SNP position on nucleotide sequence | Alternative nucleic acid | Previously known SNP? |
| --- | --- | --- |
| 230 | C -> T | No |
| 231 | C -> T | No |
| 310 | C -> A | Yes |
| 432 | G -> | No |
| 969 | C -> | No |
| 1158 | G -> | No |
| 1752 | T -> G | No |
| 2030 | C -> | No |
| 2091 | G -> A | No |
| 2092 | C -> A | No |
| 2174 | A -> G | No |
| 2175 | A -> G | No |
| 2232 | C -> T | Yes |
| 2783 | G -> C | No |
| 2862 | C -> A | Yes |
| 3695 | G -> A | Yes |

Variant protein R35137_PEA_1_PEA_1_PEA_1_P11 (SEQ ID NO:1387) according to the present invention has an amino acid sequence as given at the end of the application; it is encoded by transcript(s) R35137_PEA_1_PEA_1_PEA_1_T14 (SEQ ID NO:119). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison Report Between R35137_PEA_1_PEA_1_PEA_1_P11 (SEQ ID NO:1387) and ALAT_HUMAN_V1 (SEQ ID NO:1453):

1. An isolated chimeric polypeptide encoding for R35137_PEA_1_PEA_1_PEA_1_P11 (SEQ ID NO:1387), comprising a first amino acid sequence being at least 90% homologous to MASSTGDRSQAVRHGLRAKV-LTLDGMNPRVRRVEYAVRGPIV-QRALELEQELRQGVK KPFTEVIRAN-IGDAQAMGQRPITFLRQVLALCVNPDLLSSPNFP DDAKKRAERILQACG GHSLGAYSVSSGIQLIRED-VARYIERRDGGIPADPNNVFLSTGAS-DAIVTVLKLLVAGEG HTRTGVLIPIPQYPLYSATLAEL-GAVQVDYYLDEERAWALDVAELHRALGQAR corresponding to amino acids 1-229 of ALAT_HUMAN_V1 (SEQ ID NO:1453), which also corresponds to amino acids 1-229 of R35137_PEA_1_PEA_1_PEA_1_P11 (SEQ ID NO: 1387), and a second amino acid sequence being at least 90% homologous to SGFGQREGTYHFRMTILPPLEKLR-LLLEKLSRFHAKFTLEYS corresponding to amino acids 455-496 of ALAT_HUMAN_V1 (SEQ ID NO:1453), which also corresponds to amino acids 230-271 of R35137_PEA_1_PEA_1_PEA_1_P11 (SEQ ID NO:1387), wherein said first amino acid sequence and second amino acid sequence are contiguous and in a sequential order.

2. An isolated chimeric polypeptide encoding for an edge portion of R35137_PEA_1_PEA_1_PEA_1_P11 (SEQ ID NO:1387), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RS, having a structure as follows: a sequence starting from any of amino acid numbers 229−x to 229; and ending at any of amino acid numbers 230+((n−2)−x), in which x varies from 0 to n−2.

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 1010

Changes to ALAT_HUMAN_V1 (SEQ ID NO: 1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P11 (SEQ ID NO:1387) also has the following non-silent SNPs (Single Nucleotide Polymorphisms) as listed in Table 1011, (given according to their position(s) on the amino acid sequence, with the alternative amino acid(s) listed; the last column indicates whether the SNP is known or not; the presence of known SNPs in variant protein R35137_PEA_1_PEA_1_PEA_1_P11 (SEQ ID NO:1387) sequence provides support for the deduced sequence of this variant protein according to the present invention).

TABLE 1011

Amino acid mutations

| SNP position(s) on amino acid sequence | Alternative amino acid(s) | Previously known SNP? |
|---|---|---|
| 14 | H -> N | Yes |
| 54 | Q -> | No |

Variant protein R35137_PEA_1_PEA_1_PEA_1_P11 (SEQ ID NO:1387) is encoded by the following transcript(s): R35137_PEA_1_PEA_1_PEA_1_T14 (SEQ ID NO:119), for which the sequence(s) is/are given at the end of the application. The coding portion of transcript R35137_PEA_1_PEA_1_PEA__T14 (SEQ ID NO:119) is shown in bold; this coding portion starts at position 271 and ends at position 1083. The transcript also has the following SNPs as listed in Table 1012 (given according to their position on the nucleotide sequence, with the alternative nucleic acid listed; the last column indicates whether the SNP is known or not; the presence of known SNPs in variant protein R35137_PEA_1_PEA_1_PEA_1_P11 (SEQ ID NO:1387) sequence provides support for the deduced sequence of this variant protein according to the present invention).

TABLE 1012

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 1115 | C -> | No |
| 1176 | G -> A | No |
| 1177 | C -> A | No |

Variant protein R35137_PEA_1_PEA_1_PEA_1_P2 (SEQ ID NO:1388) according to the present invention has an amino acid sequence as given at the end of the application; it is encoded by transcript(s) R35137_PEA_1_PEA_1_PEA_1_T3 (SEQ ID NO:114). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison Report Between R35137_PEA_1_PEA_1_PEA_1_P2 (SEQ ID NO:1388) and ALAT_HUMAN_V1 (SEQ ID NO:1453):

1. An isolated chimeric polypeptide encoding for R35137_PEA_1_PEA_1_PEA_1_P2 (SEQ ID NO:1388), comprising a first amino acid sequence being at least 90% homologous to MASSTGDRSQAVRHGLRAKVLTLDG-MNPRVRRVEYAVRGPIVQRALELEQELRQGVK KPFTEVIRANIGDAQAMGQRPITFLRQV-LALCVNPDLLSSPNFPDDAKKRAERILQACG GHSL-GAYSVSSGIQLIREDVARYIERRDGGI-PADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEV corresponding to amino acids 1-274 of ALAT_HUMAN_V1 (SEQ ID NO:1453), which also corresponds to amino acids 1-274 of R35137_PEA_1_PEA_1_PEA_1_P2 (SEQ ID NO:1388), and a second amino acid sequence being at least 70%, optionally at least 80%, preferably at least 85%, more preferably at least 90% and most preferably at least 95% homologous to a polypeptide having the sequence RGAGEREAGQQSAPVTP-CALPGVPGQRVRRGFAVPLIQEGAHGD-GAALRRAAGACLLP LHLQGLHGRVRVPRRLCGGGE-HGRCSAAADAEADECAAVPAGARTGPAGPGGQPAR AHRPLLCAVPG (SEQ ID NO:1739) corresponding to amino acids 275-399 of R35137_PEA_1_PEA_1_PEA_1_P2 (SEQ ID NO:1388), wherein said first amino acid sequence and second amino acid sequence are contiguous and in a sequential order.

2. An isolated polypeptide encoding for a tail of R35137_PEA_1_PEA_1_PEA_1_P2 (SEQ ID NO:1388), comprising a polypeptide being at least 70%, optionally at least about 80%, preferably at least about 85%, more preferably at least about 90% and most preferably at least about 95% homologous to the sequence RGAGEREAGQQSAPVTP-CALPGVPGQRVRRGFAVPLIQEGAHGD-GAALRRAAGACLLP LHLQGLHGRVRVPRRLCGGGE-HGRCSAAADAEADECAAVPAGARTGPAGPGGQPAR AHRPLLCAVPG (SEQ ID NO:1739) in R35137_PEA_1_PEA_1_PEA_1_P2 (SEQ ID NO:1388).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 1013

Changes to ALAT_HUMAN_V1 (SEQ ID NO: 1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P2 (SEQ ID NO:1388) also has the following non-silent SNPs (Single Nucleotide Polymorphisms) as listed in Table 1014, (given according to their position(s) on the amino acid sequence, with the alternative amino acid(s) listed; the last column indicates whether the SNP is known or not; the presence of known SNPs in variant protein R35137_PEA_1_PEA_1_PEA_1_P2 (SEQ ID NO:1388) sequence provides support for the deduced sequence of this variant protein according to the present invention).

TABLE 1014

Amino acid mutations

| SNP position(s) on amino acid sequence | Alternative amino acid(s) | Previously known SNP? |
|---|---|---|
| 14 | H -> N | Yes |
| 54 | Q -> | No |
| 233 | R -> | No |
| 319 | G -> | No |

Variant protein R35137_PEA_1_PEA_1_PEA_1_P2 (SEQ ID NO:1388) is encoded by the following transcript(s): R35137_PEA_1_PEA_1_PEA_1_T3 (SEQ ID NO:114), for which the sequence(s) is/are given at the end of the application. The coding portion of transcript R35137_PEA_1_PEA_1_PEA_1_T3 (SEQ ID NO:114) is shown in bold; this coding portion starts at position 271 and ends at position 1467. The transcript also has the following SNPs as listed in Table 1015 (given according to their position on the nucleotide sequence, with the alternative nucleic acid listed; the last column indicates whether the SNP is known or not; the presence of known SNPs in variant protein R35137_PEA_1_PEA_1_PEA_1_P2 (SEQ ID NO:1388) sequence provides support for the deduced sequence of this variant protein according to the present invention).

TABLE 1015

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 969 | C -> | No |
| 1225 | G -> | No |
| 1645 | T -> G | No |
| 1857 | C -> | No |
| 1918 | G -> A | No |
| 1919 | C -> A | No |
| 2001 | A -> G | No |
| 2002 | A -> G | No |
| 2059 | C -> T | Yes |
| 2610 | G -> C | No |
| 2689 | C -> A | Yes |
| 3522 | G -> A | Yes |

Variant protein R35137_PEA_1_PEA_1_PEA_1_P4 (SEQ ID NO:1389) according to the present invention has an amino acid sequence as given at the end of the application; it is encoded by transcript(s) R35137_PEA_1_PEA_1_PEA_1_T5 (SEQ ID NO:115). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison Report Between R35137_PEA_1_PEA_1_PEA_1_P4 (SEQ ID NO:1389) and ALAT_HUMAN_V1 (SEQ ID NO:1453):

1. An isolated chimeric polypeptide encoding for R35137_PEA_1_PEA_1_PEA_1_P4 (SEQ ID NO:1389), comprising a first amino acid sequence being at least 90% homologous to MASSTGDRSQAVRHGLRAKVLTLDG-MNPRVRRVEYAVRGPIVQRALELEQELRQGVK KPFTEVIRANIGDAQAMGQRPITFLRQV-LALCVNPDLLSSPNFPDDAKKRAERILQACG GHSL-GAYSVSSGIQLIREDVARYIERRDGGI-PADPNNVFLSTGASDAIVTVLKLLVAGEG HTRTGVLIPIPQYPLYSATLAEL-GAVQVDYYLDEERAWALDVAELHRALGQARDHCRP RALCVINPGNPTGQVQTRECIEAVIRFA-FEERLFLLADEVYQDNVYAAGSQFHSFKKVL MEMG-PPYAGQQELASFHSTSKGYMGECGFRG-GYVEVVNMDAAVQQQMLKLMSVRL CPPVPGQALLDLVVSPPAPTDPS-FAQFQAEKQAVLAELAAKAKLTEQVFNEAPGISCNP VQGAMYSFPRVQLPPRAVERAQELGLAP-DMFFCLRLLEETGICVVPGSGFGQREGTYH FRMTILPPLEKLRLLLEKLSRFHAKFTLE corresponding to amino acids 1-494 of ALAT_HUMAN_V1 (SEQ ID NO:1453), which also corresponds to amino acids 1-494 of R35137_PEA_1_PEA_1_PEA_1_P4 (SEQ ID NO:1389), and a second amino acid sequence being at least 70%, optionally at least 80%, preferably at least 85%, more preferably at least 90% and most preferably at least 95% homologous to a polypeptide having the sequence SPGRLWSPLYLLLMPG- GVGWGGCWAPASLQVPNKAVWQSD-SKKEALAAAWPAPTCL PFLQA (SEQ ID NO:1740) corresponding to amino acids 495-555 of R35137_PEA_1_PEA_1_PEA_1_P4 (SEQ ID NO:1389), wherein said first amino acid sequence and second amino acid sequence are contiguous and in a sequential order.

2. An isolated polypeptide encoding for a tail of R35137_PEA_1_PEA_1_PEA_1_P4 (SEQ ID NO:1389), comprising a polypeptide being at least 70%, optionally at least about 80%, preferably at least about 85%, more preferably at least about 90% and most preferably at least about 95% homologous to the sequence SPGRLWSPLYLLLMPG-GVGWGGCWAPASLQVPNKAVWQSD-SKKEALAAAWPAPTCL PFLQA (SEQ ID NO:1740) in R35137_PEA_1_PEA_1_PEA_1_P4 (SEQ ID NO:1389).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 1016

Changes to ALAT_HUMAN_V1 (SEQ ID NO: 1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P4 (SEQ ID NO:1389) also has the following non-silent SNPs (Single Nucleotide Polymorphisms) as listed in Table 1017, (given according to their position(s) on the amino acid sequence, with the alternative amino acid(s) listed; the last column indicates whether the SNP is known or not; the presence of known SNPs in variant protein R35137_PEA_1_PEA_1_PEA_1_P4 (SEQ ID NO:1389) sequence provides support for the deduced sequence of this variant protein according to the present invention).

TABLE 1017

Amino acid mutations

| SNP position(s) on amino acid sequence | Alternative amino acid(s) | Previously known SNP? |
|---|---|---|
| 14 | H -> N | Yes |
| 54 | Q -> | No |
| 233 | R -> | No |
| 296 | M -> | No |
| 436 | D -> E | No |
| 508 | M -> I | No |
| 509 | P -> T | No |
| 536 | K -> R | No |

Variant protein R35137_PEA_1_PEA_1_PEA_1_P4 (SEQ ID NO:1389) is encoded by the following transcript(s): R35137_PEA_1_PEA_1_PEA_1_T5 (SEQ ID NO:115), for which the sequence(s) is/are given at the end of the application. The coding portion of transcript R35137_PEA_1_PEA_1_PEA_1_T5 (SEQ ID NO:115) is shown in bold; this coding portion starts at position 271 and ends at position 1935. The transcript also has the following SNPs as listed in Table 1018 (given according to their position on the nucleotide sequence, with the alternative nucleic acid listed; the last column indicates whether the SNP is known or not; the presence of known SNPs in variant protein R35137_PEA_1_PEA_1_PEA_1_P4 (SEQ ID NO:1389) sequence provides support for the deduced sequence of this variant protein according to the present invention).

TABLE 1018

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 969 | C -> | No |
| 1158 | G -> | No |
| 1578 | T -> G | No |
| 1794 | G -> A | No |
| 1795 | C -> A | No |
| 1877 | A -> G | No |
| 1878 | A -> G | No |
| 1935 | C -> T | Yes |
| 2486 | G -> C | No |
| 2565 | C -> A | Yes |
| 3398 | G -> A | Yes |

As noted above, cluster R35137 features 20 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R35137_PEA_1_PEA_1_PEA_1_node_2 (SEQ ID NO:856) according to the present invention is supported by 19 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1019 below describes the starting and ending position of this segment on each transcript.

TABLE 1019

Segment location on transcripts

| Transcript name | Segment starting position | Segment ending position |
|---|---|---|
| R35137_PEA_1_PEA_1_PEA_1_T3 (SEQ ID NO: 114) | 1 | 266 |
| R35137_PEA_1_PEA_1_PEA_1_T5 (SEQ ID NO: 115) | 1 | 266 |

TABLE 1019-continued

Segment location on transcripts

| Transcript name | Segment starting position | Segment ending position |
|---|---|---|
| R35137_PEA_1_PEA_1_PEA_1_T10 (SEQ ID NO: 116) | 1 | 266 |
| R35137_PEA_1_PEA_1_PEA_1_T11 (SEQ ID NO: 117) | 1 | 266 |
| R35137_PEA_1_PEA_1_PEA_1_T12 (SEQ ID NO: 118) | 1 | 266 |
| R35137_PEA_1_PEA_1_PEA_1_T14 (SEQ ID NO: 119) | 1 | 266 |

Segment cluster R35137_PEA_1_PEA_1_PEA_1_node_3 (SEQ ID NO:857) according to the present invention is supported by 24 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1020 below describes the starting and ending position of this segment on each transcript.

TABLE 1020

Segment location on transcripts

| Transcript name | Segment starting position | Segment ending position |
|---|---|---|
| R35137_PEA_1_PEA_1_PEA_1_T3 (SEQ ID NO: 114) | 267 | 432 |
| R35137_PEA_1_PEA_1_PEA_1_T5 (SEQ ID NO: 115) | 267 | 432 |
| R35137_PEA_1_PEA_1_PEA_1_T10 (SEQ ID NO: 116) | 267 | 432 |
| R35137_PEA_1_PEA_1_PEA_1_T11 (SEQ ID NO: 117) | 267 | 432 |
| R35137_PEA_1_PEA_1_PEA_1_T12 (SEQ ID NO: 118) | 267 | 432 |
| R35137_PEA_1_PEA_1_PEA_1_T14 (SEQ ID NO: 119) | 267 | 432 |

Segment cluster R35137_PEA_1_PEA_1_PEA_1_node_9 (SEQ ID NO:858) according to the present invention is supported by 25 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1021 below describes the starting and ending position of this segment on each transcript.

TABLE 1021

Segment location on transcripts

| Transcript name | Segment starting position | Segment ending position |
|---|---|---|
| R35137_PEA_1_PEA_1_PEA_1_T3 (SEQ ID NO: 114) | 632 | 765 |
| R35137_PEA_1_PEA_1_PEA_1_T5 (SEQ ID NO: 115) | 632 | 765 |
| R35137_PEA_1_PEA_1_PEA_1_T10 (SEQ ID NO: 116) | 632 | 765 |
| R35137_PEA_1_PEA_1_PEA_1_T11 (SEQ ID NO: 117) | 632 | 765 |
| R35137_PEA_1_PEA_1_PEA_1_T12 (SEQ ID NO: 118) | 632 | 765 |
| R35137_PEA_1_PEA_1_PEA_1_T14 (SEQ ID NO: 119) | 632 | 765 |

Segment cluster R35137_PEA_1_PEA_1_PEA_1_node_11 (SEQ ID NO:859) according to the present invention is supported by 30 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T 11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1022 below describes the starting and ending position of this segment on each transcript.

TABLE 1022

Segment location on transcripts

| Transcript name | Segment starting position | Segment ending position |
|---|---|---|
| R35137_PEA_1_PEA_1_PEA_1_T3 (SEQ ID NO: 114) | 766 | 955 |
| R35137_PEA_1_PEA_1_PEA_1_T5 (SEQ ID NO: 115) | 766 | 955 |
| R35137_PEA_1_PEA_1_PEA_1_T10 (SEQ ID NO: 116) | 766 | 955 |
| R35137_PEA_1_PEA_1_PEA_1_T11 (SEQ ID NO: 117) | 766 | 955 |
| R35137_PEA_1_PEA_1_PEA_1_T12 (SEQ ID NO: 118) | 766 | 955 |
| R35137_PEA_1_PEA_1_PEA_1_T14 (SEQ ID NO: 119) | 766 | 955 |

Segment cluster R35137_PEA_1_PEA_1_PEA_1_node_16 (SEQ ID NO:860) according to the present invention is supported by 23 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1023 below describes the starting and ending position of this segment on each transcript.

TABLE 1023

Segment location on transcripts

| Transcript name | Segment starting position | Segment ending position |
|---|---|---|
| R35137_PEA_1_PEA_1_PEA_1_T3 (SEQ ID NO: 114) | 1157 | 1293 |
| R35137_PEA_1_PEA_1_PEA_1_T5 (SEQ ID NO: 115) | 1090 | 1226 |
| R35137_PEA_1_PEA_1_PEA_1_T10 (SEQ ID NO: 116) | 1157 | 1293 |
| R35137_PEA_1_PEA_1_PEA_1_T11 (SEQ ID NO: 117) | 1090 | 1226 |
| R35137_PEA_1_PEA_1_PEA_1_T12 (SEQ ID NO: 118) | 1157 | 1293 |

Segment cluster R35137_PEA_1_PEA_1_PEA_1_node_18 (SEQ ID NO:861) according to the present invention is supported by 24 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1024 below describes the starting and ending position of this segment on each transcript.

TABLE 1024

Segment location on transcripts

| Transcript name | Segment starting position | Segment ending position |
|---|---|---|
| R35137_PEA_1_PEA_1_PEA_1_T3 (SEQ ID NO: 114) | 1294 | 1468 |
| R35137_PEA_1_PEA_1_PEA_1_T5 (SEQ ID NO: 115) | 1227 | 1401 |
| R35137_PEA_1_PEA_1_PEA_1_T10 (SEQ ID NO: 116) | 1394 | 1568 |
| R35137_PEA_1_PEA_1_PEA_1_T11 (SEQ ID NO: 117) | 1327 | 1501 |
| R35137_PEA_1_PEA_1_PEA_1_T12 (SEQ ID NO: 118) | 1394 | 1568 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 1025.

TABLE 1025

Oligonucleotides related to this segment

| Oligonucleotide name | Overexpressed in cancers | Chip reference |
|---|---|---|
| R35137_0_5_0 | lung malignant tumors | LUN |

Segment cluster R35137_PEA_1_PEA_1_PEA_1_node_20 (SEQ ID NO:862) according to the present invention is supported by 29 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:16), R35137_PEA_1_PEA_1_PEA_1_T11 (SEQ ID NO:117) and R35137_PEA_1_PEA_1_PEA_1_T12 (SEQ ID NO:118). Table 1026 below describes the starting and ending position of this segment on each transcript.

TABLE 1026

Segment location on transcripts

| Transcript name | Segment starting position | Segment ending position |
|---|---|---|
| R35137_PEA_1_PEA_1_PEA_1_T3 (SEQ ID NO: 114) | 1469 | 1624 |
| R35137_PEA_1_PEA_1_PEA_1_T5 (SEQ ID NO: 115) | 1402 | 1557 |
| R35137_PEA_1_PEA_1_PEA_1_T10 (SEQ ID NO: 116) | 1569 | 1724 |
| R35137_PEA_1_PEA_1_PEA_1_T11 (SEQ ID NO: 117) | 1502 | 1657 |
| R35137_PEA_1_PEA_1_PEA_1_T12 (SEQ ID NO: 118) | 1569 | 1724 |

Segment cluster R35137_PEA_1_PEA_1_PEA_1_node_27 (SEQ ID NO:863) according to the present invention is supported by 39 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1027 below describes the starting and ending position of this segment on each transcript.

TABLE 1027

Segment location on transcripts

| Transcript name | Segment starting position | Segment ending position |
|---|---|---|
| R35137_PEA_1_PEA_1_PEA_1_T3 (SEQ ID NO: 114) | 1876 | 3898 |
| R35137_PEA_1_PEA_1_PEA_1_T5 (SEQ ID NO: 115) | 1752 | 3774 |
| R35137_PEA_1_PEA_1_PEA_1_T10 (SEQ ID NO: 116) | 1976 | 3998 |
| R35137_PEA_1_PEA_1_PEA_1_T11 (SEQ ID NO: 117) | 2049 | 4071 |
| R35137_PEA_1_PEA_1_PEA_1_T12 (SEQ ID NO: 118) | 2116 | 4138 |
| R35137_PEA_1_PEA_1_PEA_1_T14 (SEQ ID NO: 119) | 1134 | 1250 |

According to an optional embodiment of the present invention, short segments related to the above cluster are also provided. These segments are up to about 120 bp in length, and so are included in a separate description.

Segment cluster R35137_PEA_1_PEA_1_PEA_1_node_5 (SEQ ID NO:864) according to the present invention is supported by 20 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_

1_PEA_1_PEA_1_T11 (SEQ ID NO:117), R35137_PEA_1_PEA_1_PEA__T12 (SEQ ID NO:118) and R35137_PEA_1_PEA_1_PEA_1_T14 (SEQ ID NO:119). Table 1028 below describes the starting and ending position of this segment on each transcript.

TABLE 1028

Segment location on transcripts

| Transcript name | Segment starting position | Segment ending position |
|---|---|---|
| R35137_PEA_1_PEA_1_PEA_1_T3 (SEQ ID NO: 114) | 433 | 522 |
| R35137_PEA_1_PEA_1_PEA_1_T5 (SEQ ID NO: 115) | 433 | 522 |
| R35137_PEA_1_PEA_1_PEA_1_T10 (SEQ ID NO: 116) | 433 | 522 |
| R35137_PEA_1_PEA_1_PEA_1_T11 (SEQ ID NO: 117) | 433 | 522 |
| R35137_PEA_1_PEA_1_PEA_1_T12 (SEQ ID NO: 118) | 433 | 522 |
| R35137_PEA_1_PEA_1_PEA_1_T14 (SEQ ID NO: 119) | 433 | 522 |

Segment cluster R35137_PEA_1_PEA_1_PEA_1_node_7 (SEQ ID NO:865) according to the present invention is supported by 23 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1029 below describes the starting and ending position of this segment on each transcript.

TABLE 1029

Segment location on transcripts

| Transcript name | Segment starting position | Segment ending position |
|---|---|---|
| R35137_PEA_1_PEA_1_PEA_1_T3 (SEQ ID NO: 114) | 523 | 631 |
| R35137_PEA_1_PEA_1_PEA_1_T5 (SEQ ID NO: 115) | 523 | 631 |
| R35137_PEA_1_PEA_1_PEA_1_T10 (SEQ ID NO: 116) | 523 | 631 |
| R35137_PEA_1_PEA_1_PEA_1_T11 (SEQ ID NO: 117) | 523 | 631 |
| R35137_PEA_1_PEA_1_PEA_1_T12 (SEQ ID NO: 118) | 523 | 631 |
| R35137_PEA_1_PEA_1_PEA_1_T14 (SEQ ID NO: 119) | 523 | 631 |

Segment cluster R35137_PEA_1_PEA_1_PEA_1_node_12 (SEQ ID NO:866) according to the present invention is supported by 22 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1030 below describes the starting and ending position of this segment on each transcript.

TABLE 1030

Segment location on transcripts

| Transcript name | Segment starting position | Segment ending position |
|---|---|---|
| R35137_PEA_1_PEA_1_PEA_1_T3 (SEQ ID NO: 114) | 956 | 1009 |
| R35137_PEA_1_PEA_1_PEA_1_T5 (SEQ ID NO: 115) | 956 | 1009 |
| R35137_PEA_1_PEA_1_PEA_1_T10 (SEQ ID NO: 116) | 956 | 1009 |
| R35137_PEA_1_PEA_1_PEA_1_T11 (SEQ ID NO: 117) | 956 | 1009 |
| R35137_PEA_1_PEA_1_PEA_1_T12 (SEQ ID NO: 118) | 956 | 1009 |

Segment cluster R35137_PEA_1_PEA_1_PEA_1_node_14 (SEQ ID NO:867) according to the present invention is supported by 23 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T2 (SEQ ID NO:118) Table 1031 below describes the starting and ending position of this segment on each transcript.

TABLE 1031

Segment location on transcripts

| Transcript name | Segment starting position | Segment ending position |
|---|---|---|
| R35137_PEA_1_PEA_1_PEA_1_T3 (SEQ ID NO: 114) | 1010 | 1089 |
| R35137_PEA_1_PEA_1_PEA_1_T5 (SEQ ID NO: 115) | 1010 | 1089 |
| R35137_PEA_1_PEA_1_PEA_1_T10 (SEQ ID NO: 116) | 1010 | 1089 |
| R35137_PEA_1_PEA_1_PEA_1_T11 (SEQ ID NO: 117) | 1010 | 1089 |
| R35137_PEA_1_PEA_1_PEA_1_T12 (SEQ ID NO: 118) | 1010 | 1089 |

Segment cluster R35137_PEA_1_PEA_1_PEA_1_node_15 (SEQ ID NO:868) according to the present invention is supported by 6 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T10 (SEQ ID NO:116) and R35137_PEA_1_PEA_1_PEA_1_T12 (SEQ ID NO:118). Table 1032 below describes the starting and ending position of this segment on each transcript.

TABLE 1032

Segment location on transcripts

| Transcript name | Segment starting position | Segment ending position |
|---|---|---|
| R35137_PEA_1_PEA_1_PEA_1_T3 (SEQ ID NO: 114) | 1090 | 1156 |
| R35137_PEA_1_PEA_1_PEA_1_T10 (SEQ ID NO: 116) | 1090 | 1156 |
| R35137_PEA_1_PEA_1_PEA_1_T12 (SEQ ID NO: 118) | 1090 | 1156 |

Segment cluster R35137_PEA_1_PEA_1_PEA_1_node_17 (SEQ ID NO:869) according to the present invention is supported by 5 libraries. The number of libraries was determined as previously described. This segment can be found in the following transcript(s): R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1033 below describes the starting and ending position of this segment on each transcript.

TABLE 1033

Segment location on transcripts

| Transcript name | Segment starting position | Segment ending position |
|---|---|---|
| R35137_PEA_1_PEA_1_PEA_1_T10 (SEQ ID NO: 116) | 1294 | 1393 |
| R35137_PEA_1_PEA_1_PEA_1_T11 (SEQ ID NO: 117) | 1227 | 1326 |
| R35137_PEA_1_PEA_1_PEA_1_T12 (SEQ ID NO: 118) | 1294 | 1393 |

Segment cluster R35137_PEA_1_PEA_1_PEA_1_node_21 (SEQ ID NO:870) according to the present invention is supported by 6 libraries. The number of libraries was determined as previously described. This segment can be found in the following transcript(s): R35137_PEA_1_PEA_1_PEA_1_T11 (SEQ ID NO:117) and R35137_PEA_1_PEA_1_PEA_1_T12 (SEQ ID NO:118). Table 1034 below describes the starting and ending position of this segment on each transcript.

TABLE 1034

Segment location on transcripts

| Transcript name | Segment starting position | Segment ending position |
|---|---|---|
| R35137_PEA_1_PEA_1_PEA_1_T11 (SEQ ID NO: 117) | 1658 | 1731 |
| R35137_PEA_1_PEA_1_PEA_1_T12 (SEQ ID NO: 118) | 1725 | 1798 |

Segment cluster R35137_PEA_1_PEA_1_PEA_1_node_22 (SEQ ID NO:871) according to the present invention is supported by 31 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1035 below describes the starting and ending position of this segment on each transcript.

TABLE 1035

Segment location on transcripts

| Transcript name | Segment starting position | Segment ending position |
|---|---|---|
| R35137_PEA_1_PEA_1_PEA_1_T3 (SEQ ID NO: 114) | 1625 | 1697 |
| R35137_PEA_1_PEA_1_PEA_1_T5 (SEQ ID NO: 115) | 1558 | 1630 |
| R35137_PEA_1_PEA_1_PEA_1_T10 (SEQ ID NO: 116) | 1725 | 1797 |
| R35137_PEA_1_PEA_1_PEA_1_T11 (SEQ ID NO: 117) | 1732 | 1804 |
| R35137_PEA_1_PEA_1_PEA_1_T12 (SEQ ID NO: 118) | 1799 | 1871 |

Segment cluster R35137_PEA_1_PEA_1_PEA_1_node_23 (SEQ ID NO:872) according to the present invention is supported by 29 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1036 below describes the starting and ending position of this segment on each transcript.

TABLE 1036

Segment location on transcripts

| Transcript name | Segment starting position | Segment ending position |
|---|---|---|
| R35137_PEA_1_PEA_1_PEA_1_T3 (SEQ ID NO: 114) | 1698 | 1737 |
| R35137_PEA_1_PEA_1_PEA_1_T5 (SEQ ID NO: 115) | 1631 | 1670 |
| R35137_PEA_1_PEA_1_PEA_1_T10 (SEQ ID NO: 116) | 1798 | 1837 |
| R35137_PEA_1_PEA_1_PEA_1_T11 (SEQ ID NO: 117) | 1805 | 1844 |
| R35137_PEA_1_PEA_1_PEA_1_T12 (SEQ ID NO: 118) | 1872 | 1911 |
| R35137_PEA_1_PEA_1_PEA_1_T14 (SEQ ID NO: 119) | 956 | 995 |

Segment cluster R35137_PEA_1_PEA_1_PEA_1_node_24 (SEQ ID NO:873) according to the present invention is supported by 5 libraries. The number of libraries was determined as previously described. This segment can be found in the following transcript(s): R35137_PEA_1_PEA_1_PEA_1_T11 (SEQ ID NO:117) and R35137_PEA_1_PEA_1_PEA_1_T12 (SEQ ID NO:118). Table 1037 below describes the starting and ending position of this segment on each transcript.

TABLE 1037

Segment location on transcripts

| Transcript name | Segment starting position | Segment ending position |
|---|---|---|
| R35137_PEA_1_PEA_1_PEA_1_T11 (SEQ ID NO: 117) | 1845 | 1910 |
| R35137_PEA_1_PEA_1_PEA_1_T12 (SEQ ID NO: 118) | 1912 | 1977 |

Segment cluster R35137_PEA_1_PEA_1_PEA_1_node_25 (SEQ ID NO:874) according to the present invention is supported by 30 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA__T12 (SEQ ID NO:118) and R35137_PEA_1_PEA_1_PEA_1_T14 (SEQ ID NO:119). Table 1038 below describes the starting and ending position of this segment on each transcript.

TABLE 1038

Segment location on transcripts

| Transcript name | Segment starting position | Segment ending position |
|---|---|---|
| R35137_PEA_1_PEA_1_PEA_1_T3 (SEQ ID NO: 114) | 1738 | 1818 |
| R35137_PEA_1_PEA_1_PEA_1_T5 (SEQ ID NO: 115) | 1671 | 1751 |
| R35137_PEA_1_PEA_1_PEA_1_T10 (SEQ ID NO: 116) | 1838 | 1918 |
| R35137_PEA_1_PEA_1_PEA_1_T11 (SEQ ID NO: 117) | 1911 | 1991 |
| R35137_PEA_1_PEA_1_PEA_1_T12 (SEQ ID NO: 118) | 1978 | 2058 |
| R35137_PEA_1_PEA_1_PEA_1_T14 (SEQ ID NO: 119) | 996 | 1076 |

Segment cluster R35137_PEA_1_PEA_1_PEA_1_node_26 (SEQ ID NO:875) according to the present invention is supported by 29 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1039 below describes the starting and ending position of this segment on each transcript.

TABLE 1039

Segment location on transcripts

| Transcript name | Segment starting position | Segment ending position |
|---|---|---|
| R35137_PEA_1_PEA_1_PEA_1_T3 (SEQ ID NO: 114) | 1819 | 1875 |
| R35137_PEA_1_PEA_1_PEA_1_T10 (SEQ ID NO: 116) | 1919 | 1975 |
| R35137_PEA_1_PEA_1_PEA_1_T11 (SEQ ID NO: 117) | 1992 | 2048 |
| R35137_PEA_1_PEA_1_PEA_1_T12 (SEQ ID NO: 118) | 2059 | 2115 |
| R35137_PEA_1_PEA_1_PEA_1_T14 (SEQ ID NO: 119) | 1077 | 1133 |

Variant Protein Alignment to the Previously Known Protein:

Sequence name: ALAT_HUMAN_V1 (SEQ ID NO:1453)

Sequence documentation:

Alignment of: R35137_PEA_1_PEA_1_PEA_1_P9 (SEQ ID NO:1385) x ALAT_HUMAN_V1 (SEQ ID NO:1453)..

Alignment segment 1/1:

| Quality: | 2619.00 | Escore: | 0 |
|---|---|---|---|
| Matching length: | 274 | Total length: | 274 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    ||||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPDLLSSPNF 100
    ||||||||||||||||||||||||||||||||||||||||||||||||||
 51 ELRQGVKKPFTEVIRANIGDAQAMGQRPITFLRQVLALCVNPDLLSSPNF 100

101 PDDAKKRAERILQACGGHSLGAYSVSSGIQLIREDVARYIERRDGGIPAD 150
    ||||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    ||||||||||||||||||||||||||||||||||||||||||||||||||
151 PNNVFLSTGASDAIVTVLKLLVAGEGHTRTGVLIPIPQYPLYSATLAELG 200
```

-continued

```
201 AVQVDYYLDEERAWALDVAELHRALGQARDHCRPRALCVINPGNPTGQVQ 250
    ||||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEV                           274
    |||||||||||||||||||||||
251 TRECIEAVIRFAFEERLFLLADEV                           274
```

Sequence name: ALAT_HUMAN_V1 (SEQ ID NO:1453)
Sequence documentation:
Alignment of: R35137_PEA_1_PEA_1_PEA_1_P8 (SEQ ID NO:1386) x ALAT_HUMAN_V1 (SEQ ID NO:1453)..
Alignment segment 1/1:

| | | | |
|---|---|---|---|
| Quality: | 3088.00 | Escore: | 0 |
| Matching length: | 320 | Total length: | 320 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    ||||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPDLLSSPNF 100
    ||||||||||||||||||||||||||||||||||||||||||||||||||
 51 ELRQGVKKPFTEVIRANIGDAQAMGQRPITFLRQVLALCVNPDLLSSPNF 100

101 PDDAKKRAERILQACGGHSLGAYSVSSGIQLIREDVARYIERRDGGIPAD 150
    ||||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    ||||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQARDHCRPRALCVINPGNPTGQVQ 250
    ||||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEVYQDNVYAAGSQFHSFKKVLMEMGPPY 300
    ||||||||||||||||||||||||||||||||||||||||||||||||||
251 TRECIEAVIRFAFEERLFLLADEVYQDNVYAAGSQFHSFKKVLMEMGPPY 300

301 AGQQELASFHSTSKGYMGEC                               320
    ||||||||||||||||||||
301 AGQQELASFHSTSKGYMGEC                               320
```

Sequence name: ALAT_HUMAN_V1 (SEQ ID NO:1453)
Sequence documentation:
Alignment of: R35137_PEA_1_PEA_1_PEA_1_P11 (SEQ ID NO:1387) x ALAT_HUMAN_V1 (SEQ ID NO:1453) ..
Alignment segment 1/1:

| | | | |
|---|---|---|---|
| Quality: | 2487.00 | Escore: | 0 |
| Matching length: | 271 | Total length: | 496 |
| Matching Percent Similarity: | 100.00 | Matching Percent Identity: | 100.00 |
| Total Percent Similarity: | 54.64 | Total Percent Identity: | 54.64 |
| Gaps: | 1 | | |

Alignment:

```
  1 MASSTGDRSQAVRHGLRAKVLTLDGMNPRVRRVEYAVRGPIVQRALELEQ  50
    ||||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPOLLSSPNF 100
    ||||||||||||||||||||||||||||||||||||||||||||||||||
 51 ELRQGVKKPFTEVIRANIGDAQAMGQRPITFLRQVLALCVNPOLLSSPNF 100

101 PDDAKKRAERILQACGGHSLGAYSVSSGIQLIREDVARYIERRDGGIPAD 150
    ||||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    ||||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQAR..................... 229
    ||||||||||||||||||||||||||||
201 AVQVDYYLDEERAWALDVAELHRALGQARDHCRPRALCVINPGNPTGQVQ 250

229 ................................................. 229
251 TRECIEAVIRFAFEERLFLLADEVYQDNVYAAGSQFHSFKKVLMEMGPPY 300

229 ................................................. 229
301 AGQQELASFHSTSKGYMGECGFRGGYVEVVNMDAAVQQQMLKLMSVRLCP 350

229 ................................................. 229
351 PVPGQALLDLVVSPPAPTDPSFAQFQAEKQAVLAELAAKAKLTEQVFNEA 400

229................................................  229
401 PGISCNPVQGAMYSFPRVQLPPRAVERAQELGLAPDMFFCLRLLEETGIC 450

230 ....SGFGQREGTYHFRMTILPPLEKLRLLLEKLSRFHAKFTLEYS     271
        |||||||||||||||||||||||||||||||||||||||||||
451 VVPGSGFGQREGTYHFRMTILPPLEKLRLLLEKLSRFHAKFTLEYS     496
```

Sequence name: ALAT_HUMAN_V1 (SEQ ID NO:1453)
Sequence documentation:
Alignment of: R35137_PEA_1_PEA_1_PEA_1_P2 (SEQ ID NO:1388) x ALAT_HUMAN_V1 (SEQ ID NO:1453)..
Alignment segment 1/1:

| | | | |
|---|---|---|---|
| Quality: | 2619.00 | Escore: | 0 |
| Matching length: | 274 | Total length: | 274 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    |||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPOLLSSPNF 100
    |||||||||||||||||||||||||||||||||||||||||||||||||
 51 ELRQGVKKPFTEVIRANIGDAQAMGQRPITFLRQVLALCVNPOLLSSPNF 100

101 PDDAKKRAERILQACGGHSLGAYSVSSGIQLIREDVARYIERRDGGIPAD 150
    |||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    |||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQARDHCRPRALCVINPGNPTGQVQ 250
    |||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEV                           274
    ||||||||||||||||||||||||
251 TRECIEAVIRFAFEERLFLLADEV                           274
```

Sequence name: ALAT_HUMAN_V1 (SEQ ID NO:1453)
Sequence documentation:
Alignment of: R35137_PEA_1_PEA_1_PEA_1_P4 (SEQ ID NO:1389) x ALAT_HUMAN_V1 (SEQ ID NO:1453)..
Alignment segment 1/1:

| | | | |
|---|---|---|---|
| Quality: | 4785.00 | Escore: | 0 |
| Matching length: | 494 | Total length: | 494 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    |||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPOLLSSPNF 100
    |||||||||||||||||||||||||||||||||||||||||||||||||
 51 ELRQGVKKPFTEVIRANIGDAQAMGQRPITFLRQVLALCVNPOLLSSPNF 100

101 PDDAKKRAERILQACGGHSLGAYSVSSGIQLIREDVARYIERRDGGIPAD 150
    |||||||||||||||||||||||||||||||||||||||||||||||||
101 PDDAKKRAERILQACGGHSLGAYSVSSGIQLIREDVARYIERRDGGIPAD 150
```

-continued

```
151 PNNVFLSTGASDAIVTVLKLLVAGEGHTRTGVLIPIPQYPLYSATLAELG 200
    ||||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQARDHCRPRALCVINPGNPTGQVQ 250
    ||||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEVYQDNVYAAGSQFHSFKKVLMEMGPPY 300
    ||||||||||||||||||||||||||||||||||||||||||||||||||
251 TRECIEAVIRFAFEERLFLLADEVYQDNVYAAGSQFHSFKKVLMEMGPPY 300

301 AGQQELASFHSTSKGYMGECGFRGGYVEVVNMDAAVQQQMLKLMSVRLCP 350
    ||||||||||||||||||||||||||||||||||||||||||||||||||
301 AGQQELASFHSTSKGYMGECGFRGGYVEVVNMDAAVQQQMLKLMSVRLCP 350

351 PVPGQALLDLVVSPPAPTDPSFAQFQAEKQAVLAELAAKAKLTEQVFNEA 400
    ||||||||||||||||||||||||||||||||||||||||||||||||||
351 PVPGQALLDLVVSPPAPTDPSFAQFQAEKQAVLAELAAKAKLTEQVFNEA 400

401 PGISCNPVQGAMYSFPRVQLPPRAVERAQELGLAPDMFFCLRLLEETGIC 450
    ||||||||||||||||||||||||||||||||||||||||||||||||||
401 PGISCNPVQGAMYSFPRVQLPPRAVERAQELGLAPDMFFCLRLLEETGIC 450

451 VVPGSGFGQREGTYHFRMTILPPLEKLRLLLEKLSRFHAKFTLE       494
    |||||||||||||||||||||||||||||||||||||||||||
451 VVPGSGFGQREGTYHFRMTILPPLEKLRLLLEKLSRFHAKFTLE       494
```

Description for Cluster Z25299

Cluster Z25299 features 5 transcript(s) and 11 segment(s) of interest, the names for which are given in Tables 1040 and 1041, respectively, the sequences themselves are given at the end of the application. The selected protein variants are given in table 1042.

TABLE 1040

Transcripts of interest

| Transcript Name | Sequence ID No. |
|---|---|
| Z25299_PEA_2_T1 | 120 |
| Z25299_PEA_2_T2 | 121 |
| Z25299_PEA_2_T3 | 122 |
| Z25299_PEA_2_T6 | 123 |
| Z25299_PEA_2_T9 | 124 |

TABLE 1041

Segments of interest

| Segment Name | Sequence ID No. |
|---|---|
| Z25299_PEA_2_node_20 | 876 |
| Z25299_PEA_2_node_21 | 877 |
| Z25299_PEA_2_node_23 | 878 |
| Z25299_PEA_2_node_24 | 879 |
| Z25299_PEA_2_node_8 | 880 |
| Z25299_PEA_2_node_12 | 881 |
| Z25299_PEA_2_node_13 | 882 |
| Z25299_PEA_2_node_14 | 883 |
| Z25299_PEA_2_node_17 | 884 |
| Z25299_PEA_2_node_18 | 885 |
| Z25299_PEA_2_node_19 | 886 |

TABLE 1042

Proteins of interest

| Protein Name | Sequence ID No. |
|---|---|
| Z25299_PEA_2_P2 | 1390 |
| Z25299_PEA_2_P3 | 1391 |
| Z25299_PEA_2_P7 | 1392 |
| Z25299_PEA_2_P10 | 1393 |

These sequences are variants of the known protein Antileukoproteinase 1 precursor (SwissProt accession identifier ALK1_HUMAN; known also according to the synonyms ALP; HUSI-1; Seminal proteinase inhibitor; Secretory leukocyte protease inhibitor; BLPI; Mucus proteinase inhibitor; MPI; WAP four-disulfide core domain protein 4; Protease inhibitor WAP4), SEQ ID NO: 1454, referred to herein as the previously known protein.

Protein Antileukoproteinase 1 precursor (SEQ ID NO:1454) is known or believed to have the following function(s): Acid-stable proteinase inhibitor with strong affinities for trypsin, chymotrypsin, elastase, and cathepsin G. May prevent elastase-mediated damage to oral and possibly other mucosal tissues. The sequence for protein Antileukoproteinase 1 precursor is given at the end of the application, as "Antileukoproteinase 1 precursor amino acid sequence". Protein Antileukoproteinase 1 precursor localization is believed to be Secreted.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Elastase inhibitor; Tryptase inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anti-inflammatory; Antiasthma.

The following GO Annotation(s) apply to the previously known protein. The following annotation(s) were found: proteinase inhibitor; serine protease inhibitor, which are annotation(s) related to Molecular Function.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

Cluster Z25299 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 35 refer to weighted expression of ESTs in each category, as "parts per million" (ratio of the expression of ESTs for a particular cluster to the expression of all ESTs in that category, according to parts per million).

Figure 35:
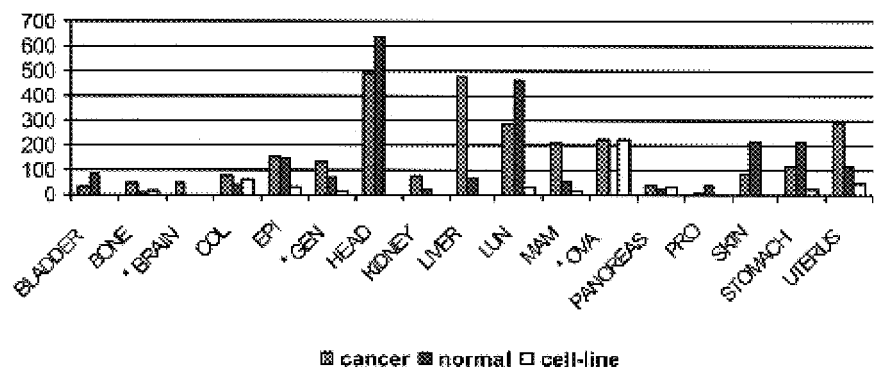
FIG. 35 is a histogram showing Cancer and cell-line vs. normal tissue expression for Cluster Z25299, demonstrating overexpression in brain malignant tumors, a mixture of malignant tumors from different tissues and ovarian carcinoma.

Overall, the following results were obtained as shown with regard to the histograms in FIG. 35 and Table 1043. This cluster is overexpressed (at least at a minimum level) in the following pathological conditions: brain malignant tumors, a mixture of malignant tumors from different tissues and ovarian carcinoma.

TABLE 1043

Normal tissue distribution

| Name of Tissue | Number |
| --- | --- |
| bladder | 82 |
| bone | 6 |
| brain | 0 |
| colon | 37 |
| epithelial | 145 |
| general | 73 |
| head and neck | 638 |
| kidney | 26 |
| liver | 68 |
| lung | 465 |
| breast | 52 |
| ovary | 0 |
| pancreas | 20 |
| prostate | 36 |
| skin | 215 |
| stomach | 219 |
| uterus | 113 |

TABLE 1044

P values and ratios for expression in cancerous tissue

| Name of Tissue | P1 | P2 | SP1 | R3 | SP2 | R4 |
| --- | --- | --- | --- | --- | --- | --- |
| bladder | 8.2e−01 | 8.5e−01 | 9.2e−01 | 0.6 | 9.7e−01 | 0.5 |
| bone | 5.5e−01 | 7.3e−01 | 4.0e−01 | 2.1 | 4.9e−01 | 1.5 |
| brain | 8.8e−02 | 1.5e−01 | 2.3e−03 | 7.7 | 1.2e−02 | 4.8 |
| colon | 3.3e−01 | 2.8e−01 | 4.2e−01 | 1.6 | 4.2e−01 | 1.5 |
| epithelial | 2.5e−01 | 7.6e−01 | 3.8e−01 | 1.0 | 1 | 0.6 |
| general | 6.4e−03 | 2.5e−01 | 1.7e−06 | 1.6 | 5.2e−01 | 0.9 |
| head and neck | 3.6e−01 | 5.9e−01 | 7.6e−01 | 0.6 | 1 | 0.3 |
| kidney | 7.4e−01 | 8.4e−01 | 2.1e−01 | 2.1 | 4.2e−01 | 1.4 |
| liver | 4.1e−01 | 9.1e−01 | 4.2e−02 | 3.2 | 6.4e−01 | 0.8 |
| lung | 7.6e−01 | 8.3e−01 | 9.8e−01 | 0.5 | 1 | 0.3 |
| breast | 5.0e−01 | 5.5e−01 | 9.8e−02 | 1.6 | 3.4e−01 | 1.1 |
| ovary | 3.7e−02 | 3.0e−02 | 6.9e−03 | 6.1 | 4.9e−03 | 5.6 |
| pancreas | 3.8e−01 | 3.6e−01 | 3.6e−01 | 1.7 | 3.9e−01 | 1.5 |
| prostate | 9.1e−01 | 9.2e−01 | 8.9e−01 | 0.5 | 9.4e−01 | 0.5 |
| skin | 6.0e−01 | 8.1e−01 | 9.3e−01 | 0.4 | 1 | 0.1 |

TABLE 1044-continued

P values and ratios for expression in cancerous tissue

| Name of Tissue | P1 | P2 | SP1 | R3 | SP2 | R4 |
| --- | --- | --- | --- | --- | --- | --- |
| stomach | 3.0e−01 | 8.1e−01 | 9.1e−01 | 0.6 | 1 | 0.3 |
| uterus | 1.6e−01 | 1.3e−01 | 3.2e−02 | 1.6 | 3.0e−01 | 1.1 |

As noted above, cluster Z25299 features 5 transcript(s), which were listed in Table 1 above. These transcript(s) encode for protein(s) which are variant(s) of protein Antileukoproteinase 1 precursor (SEQ ID NO:1454). A description of each variant protein according to the present invention is now provided.

Variant protein Z25299_PEA_2_P2 (SEQ ID NO:1390) according to the present invention has an amino acid sequence as given at the end of the application; it is encoded by transcript(s) Z25299_PEA_2_T1 (SEQ ID NO:120). An alignment is given to the known protein (Antileukoproteinase 1 precursor (SEQ ID NO:1454)) at the end of the application. One or more alignments to one or more previously published protein sequences are given at the end of the application. A brief description of the relationship of the variant protein according to the present invention to each such aligned protein is as follows:

Comparison Report Between Z25299_PEA_2_P2 (SEQ ID NO:1390) and ALK1_HUMAN (SEQ ID NO:1454):

1. An isolated chimeric polypeptide encoding for Z25299_PEA_2_P2 (SEQ ID NO:1390), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN (SEQ ID NO:1454), which also corresponds to amino acids 1-131 of Z25299_PEA_2_P2 (SEQ ID NO:1390), and a second amino acid sequence being at least 70%, optionally at least 80%, preferably at least 85%, more preferably at least 90% and most preferably at least 95% homologous to a polypeptide having the sequence GKQGMRAH (SEQ ID NO: 279) corresponding to amino acids 132-139 of Z25299_PEA_2_P2 (SEQ ID NO:1390), wherein said first and second amino acid sequences are contiguous and in a sequential order.

2. An isolated polypeptide encoding for a tail of Z25299_PEA_2_P2 (SEQ ID NO:1390), comprising a polypeptide being at least 70%, optionally at least about 80%, preferably at least about 85%, more preferably at least about 90% and most preferably at least about 95% homologous to the sequence GKQGMRAH (SEQ ID NO: 279) in Z25299_PEA_2_P2 (SEQ ID NO:1390).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P2 (SEQ ID NO:1390) also has the following non-silent SNPs (Single Nucleotide Polymorphisms) as listed in Table 1045, (given according to their position(s) on the amino acid sequence, with the alternative amino acid(s) listed; the last column indicates whether the SNP is known or not; the presence of known SNPs in variant protein Z25299_PEA_2_P2 (SEQ ID NO:1390) sequence provides support for the deduced sequence of this variant protein according to the present invention).

TABLE 1045

Amino acid mutations

| SNP position(s) on amino acid sequence | Alternative amino acid(s) | Previously known SNP? |
|---|---|---|
| 136 | M -> T | Yes |
| 20 | P -> | No |
| 43 | C -> R | No |
| 48 | K -> N | No |
| 83 | R -> K | No |
| 84 | R -> W | No |

Variant protein Z25299_PEA_2_P2 (SEQ ID NO:1390) is encoded by the following transcript(s): Z25299_PEA_2_T1 (SEQ ID NO:120), for which the sequence(s) is/are given at the end of the application. The coding portion of transcript Z25299_PEA_2_T1 (SEQ ID NO:120) is shown in bold; this coding portion starts at position 124 and ends at position 540. The transcript also has the following SNPs as listed in Table 1046 (given according to their position on the nucleotide sequence, with the alternative nucleic acid listed; the last column indicates whether the SNP is known or not; the presence of known SNPs in variant protein Z25299_PEA_2_P2 (SEQ ID NO:1390) sequence provides support for the deduced sequence of this variant protein according to the present invention).

TABLE 1046

Nucleic acid SNPs

| SNP position on nucleotide sequence | Alternative nucleic acid | Previously known SNP? |
|---|---|---|
| 122 | C -> T | No |
| 123 | C -> T | No |
| 530 | T -> C | Yes |
| 989 | C -> T | Yes |
| 1127 | C -> T | Yes |
| 1162 | A -> C | Yes |
| 1180 | A -> C | Yes |
| 1183 | A -> C | Yes |
| 1216 | A -> C | Yes |
| 1262 | G -> A | Yes |
| 183 | T -> | No |
| 250 | T -> C | No |
| 267 | A -> C | No |
| 267 | A -> G | No |
| 339 | C -> T | Yes |
| 371 | G -> A | No |
| 373 | A -> T | No |
| 435 | C -> T | No |

Variant protein Z25299_PEA_2_P3 (SEQ ID NO:1391) according to the present invention has an amino acid sequence as given at the end of the application; it is encoded by transcript(s) Z25299_PEA_2_T2 (SEQ ID NO:121). An alignment is given to the known protein (Antileukoproteinase 1 precursor (SEQ ID NO:1454)) at the end of the application. One or more alignments to one or more previously published protein sequences are given at the end of the application. A brief description of the relationship of the variant protein according to the present invention to each such aligned protein is as follows:

Comparison Report Between Z25299_PEA_2_P3 (SEQ ID NO:1391) and ALK1_HUMAN (SEQ ID NO:1454):

1. An isolated chimeric polypeptide encoding for Z25299_PEA_2_P3 (SEQ ID NO:1391), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPTRRK-PGKCPVTYGQCLMLNPPNFCEMDGQCKRDLK CCMGMCGKSCVSPVK corresponding to amino acids 1-131 of ALK1_HUMAN (SEQ ID NO:1454), which also corresponds to amino acids 1-131 of Z25299_PEA_2_P3 (SEQ ID NO:1391), and a second amino acid sequence being at least 70%, optionally at least 80%, preferably at least 85%, more preferably at least 90% and most preferably at least 95% homologous to a polypeptide having the sequence GEKRHHKQLRDQEVDPLEMRRHSAG (SEQ ID NO: 269) corresponding to amino acids 132-156 of Z25299_PEA_2_P3 (SEQ ID NO:1391), wherein said first and second amino acid sequences are contiguous and in a sequential order.

2. An isolated polypeptide encoding for a tail of Z25299_PEA_2_P3 (SEQ ID NO:1391), comprising a polypeptide being at least 70%, optionally at least about 80%, preferably at least about 85%, more preferably at least about 90% and most preferably at least about 95% homologous to the sequence GEKRHHKQLRDQEVDPLEMRRHSAG (SEQ ID NO: 269) in Z25299_PEA_2_P3 (SEQ ID NO:1391).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P3 (SEQ ID NO:1391) also has the following non-silent SNPs (Single Nucleotide Polymorphisms) as listed in Table 1047, (given according to their position(s) on the amino acid sequence, with the alternative amino acid(s) listed; the last column indicates whether the SNP is known or not; the presence of known SNPs in variant protein Z25299_PEA_2_P3 (SEQ ID NO:1391) sequence provides support for the deduced sequence of this variant protein according to the present invention).

TABLE 1047

Amino acid mutations

| SNP position(s) on amino acid sequence | Alternative amino acid(s) | Previously known SNP? |
|---|---|---|
| 20 | P -> | No |
| 43 | C -> R | No |
| 48 | K -> N | No |
| 83 | R -> K | No |
| 84 | R -> W | No |

Variant protein Z25299_PEA_2_P3 (SEQ ID NO:1391) is encoded by the following transcript(s): Z25299_PEA_2_T2 (SEQ ID NO:121), for which the sequence(s) is/are given at the end of the application. The coding portion of transcript Z25299_PEA_2_T2 (SEQ ID NO:121) is shown in bold; this coding portion starts at position 124 and ends at position 591.

The transcript also has the following SNPs as listed in Table 1048 (given according to their position on the nucleotide sequence, with the alternative nucleic acid listed; the last column indicates whether the SNP is known or not; the presence of known SNPs in variant protein Z25299_PEA_2_P3 (SEQ ID NO:1391) sequence provides support for the deduced sequence of this variant protein according to the present invention).

TABLE 1048

Nucleic acid SNPs

| SNP position on nucleotide sequence | Alternative nucleic acid | Previously known SNP? |
|---|---|---|
| 122 | C -> T | No |
| 123 | C -> T | No |
| 183 | T -> | No |
| 250 | T -> C | No |
| 267 | A -> C | No |
| 267 | A -> G | No |
| 339 | C -> T | Yes |
| 371 | G -> A | No |
| 373 | A -> T | No |
| 435 | C -> T | No |

Variant protein Z25299_PEA_2_P7 (SEQ ID NO:1392) according to the present invention has an amino acid sequence as given at the end of the application; it is encoded by transcript(s) Z25299_PEA_2_T6 (SEQ ID NO:123). An alignment is given to the known protein (Antileukoproteinase 1 precursor (SEQ ID NO:1454)) at the end of the application. One or more alignments to one or more previously published protein sequences are given at the end of the application. A brief description of the relationship of the variant protein according to the present invention to each such aligned protein is as follows:

Comparison Report Between Z25299_PEA_2_P7 (SEQ ID NO:1392) and ALK1_HUMAN (SEQ ID NO:1454):

1. An isolated chimeric polypeptide encoding for Z25299_PEA_2_P7 (SEQ ID NO:1392), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNP corresponding to amino acids 1-81 of ALK1_HUMAN (SEQ ID NO:1454), which also corresponds to amino acids 1-81 of Z25299_PEA_2_P7 (SEQ ID NO:1392), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 622) corresponding to amino acids 82-89 of Z25299_PEA_2_P7 (SEQ ID NO:1392), wherein said first and second amino acid sequences are contiguous and in a sequential order.

2. An isolated polypeptide encoding for a tail of Z25299_PEA_2_P7 (SEQ ID NO:1392), comprising a polypeptide being at least 70%, optionally at least about 80%, preferably at least about 85%, more preferably at least about 90% and most preferably at least about 95% homologous to the sequence RGSLGSAQ (SEQ ID NO: 622) in Z25299_PEA_2_P7 (SEQ ID NO:1392).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P7 (SEQ ID NO:1392) also has the following non-silent SNPs (Single Nucleotide Polymorphisms) as listed in Table 1049, (given according to their position(s) on the amino acid sequence, with the alternative amino acid(s) listed; the last column indicates whether the SNP is known or not; the presence of known SNPs in variant protein Z25299_PEA_2_P7 (SEQ ID NO:1392) sequence provides support for the deduced sequence of this variant protein according to the present invention).

TABLE 1049

Amino acid mutations

| SNP position(s) on amino acid sequence | Alternative amino acid(s) | Previously known SNP? |
|---|---|---|
| 20 | P -> | No |
| 43 | C -> R | No |
| 48 | K -> N | No |
| 82 | R -> S | No |

Variant protein Z25299_PEA_2_P7 (SEQ ID NO:1392) is encoded by the following transcript(s): Z25299_PEA_2_T6 (SEQ ID NO:123), for which the sequence(s) is/are given at the end of the application. The coding portion of transcript Z25299_PEA_2_T6 (SEQ ID NO:123) is shown in bold; this coding portion starts at position 124 and ends at position 390. The transcript also has the following SNPs as listed in Table 1050 (given according to their position on the nucleotide sequence, with the alternative nucleic acid listed; the last column indicates whether the SNP is known or not; the presence of known SNPs in variant protein Z25299_PEA_2_P7 (SEQ ID NO:1392) sequence provides support for the deduced sequence of this variant protein according to the present invention).

TABLE 1050

Nucleic acid SNPs

| SNP position on nucleotide sequence | Alternative nucleic acid | Previously known SNP? |
|---|---|---|
| 122 | C -> T | No |
| 123 | C -> T | No |
| 576 | A -> C | Yes |
| 594 | A -> C | Yes |
| 597 | A -> C | Yes |
| 630 | A -> C | Yes |
| 676 | G -> A | Yes |
| 183 | T -> | No |
| 250 | T -> C | No |
| 267 | A -> C | No |
| 267 | A -> G | No |
| 339 | C -> T | Yes |
| 369 | A -> T | No |
| 431 | C -> T | No |
| 541 | C -> T | Yes |

Variant protein Z25299_PEA_2_P10 (SEQ ID NO:1393) according to the present invention has an amino acid sequence as given at the end of the application; it is encoded by transcript(s) Z25299_PEA_2_T9 (SEQ ID NO:124). An alignment is given to the known protein (Antileukoproteinase 1 precursor (SEQ ID NO:1454)) at the end of the application. One or more alignments to one or more previously published protein sequences are given at the end of the application. A brief description of the relationship of the variant protein according to the present invention to each such aligned protein is as follows:

Comparison Report Between Z25299_PEA_2_P10 (SEQ ID NO:1393) and ALK1_HUMAN (SEQ ID NO:1454):

1. An isolated chimeric polypeptide encoding for Z25299_PEA_2_P10 (SEQ ID NO:1393), comprising a first amino acid sequence being at least 90% homologous to MKSSGLFPFLVLLALGTLAPWAVEGS-GKSFKAGVCPPKKSAQCLRYKKPECQSDWQCP GKKRCCPDTCGIKCLDPVDTPNPT corresponding to amino acids 1-82 of ALK1_HUMAN (SEQ ID NO:1454), which also corresponds to amino acids 1-82 of Z25299_PEA_2_P10 (SEQ ID NO:1393).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P10 (SEQ ID NO:1393) also has the following non-silent SNPs (Single Nucleotide Polymorphisms) as listed in Table 1051, (given according to their position(s) on the amino acid sequence, with the alternative amino acid(s) listed; the last column indicates whether the SNP is known or not; the presence of known SNPs in variant protein Z25299_PEA_2_P10 (SEQ ID NO:1393) sequence provides support for the deduced sequence of this variant protein according to the present invention).

TABLE 1051

Amino acid mutations

| SNP position(s) on amino acid sequence | Alternative amino acid(s) | Previously known SNP? |
|---|---|---|
| 20 | P -> | No |
| 43 | C -> R | No |
| 48 | K -> N | No |

Variant protein Z25299_PEA_2_P10 (SEQ ID NO:1393) is encoded by the following transcript(s): Z25299_PEA_2_T9 (SEQ ID NO:124), for which the sequence(s) is/are given at the end of the application. The coding portion of transcript Z25299_PEA_2_T9 (SEQ ID NO:124) is shown in bold; this coding portion starts at position 124 and ends at position 369. The transcript also has the following SNPs as listed in Table 1052 (given according to their position on the nucleotide sequence, with the alternative nucleic acid listed; the last column indicates whether the SNP is known or not; the presence of known SNPs in variant protein Z25299_PEA_2_P10 (SEQ ID NO:1393) sequence provides support for the deduced sequence of this variant protein according to the present invention).

TABLE 1052

Nucleic acid SNPs

| SNP position on nucleotide sequence | Alternative nucleic acid | Previously known SNP? |
|---|---|---|
| 122 | C -> T | No |
| 123 | C -> T | No |

TABLE 1052-continued

Nucleic acid SNPs

| SNP position on nucleotide sequence | Alternative nucleic acid | Previously known SNP? |
|---|---|---|
| 451 | A -> C | Yes |
| 484 | A -> C | Yes |
| 530 | G -> A | Yes |
| 183 | T -> | No |
| 250 | T -> C | No |
| 267 | A -> C | No |
| 267 | A -> G | No |
| 339 | C -> T | Yes |
| 395 | C -> T | Yes |
| 430 | A -> C | Yes |
| 448 | A -> C | Yes |

As noted above, cluster Z25299 features 11 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z25299_PEA_2_node_20 (SEQ ID NO:876) according to the present invention is supported by 6 libraries. The number of libraries was determined as previously described. This segment can be found in the following transcript(s): Z25299_PEA_2_T1 (SEQ ID NO:120). Table 1053 below describes the starting and ending position of this segment on each transcript.

TABLE 1053

Segment location on transcripts

| Transcript name | Segment starting position | Segment ending position |
|---|---|---|
| Z25299_PEA_2_T1 (SEQ ID NO: 120) | 518 | 1099 |

Segment cluster Z25299_PEA_2_node_21 (SEQ ID NO:877) according to the present invention is supported by 162 libraries. The number of libraries was determined as previously described. This segment can be found in the following transcript(s): Z25299_PEA_2_T1 (SEQ ID NO:120), Z25299_PEA_2_T6 (SEQ ID NO:123) and Z25299_PEA_2_T9 (SEQ ID NO:124). Table 1054 below describes the starting and ending position of this segment on each transcript.

TABLE 1054

Segment location on transcripts

| Transcript name | Segment starting position | Segment ending position |
|---|---|---|
| Z25299_PEA_2_T1 (SEQ ID NO: 120) | 1100 | 1292 |
| Z25299_PEA_2_T6 (SEQ ID NO: 123) | 514 | 706 |
| Z25299_PEA_2_T9 (SEQ ID NO: 124) | 368 | 560 |

Segment cluster Z25299_PEA_2_node_23 (SEQ ID NO:878) according to the present invention is supported by 2 libraries. The number of libraries was determined as previously described. This segment can be found in the following transcript(s): Z25299_PEA_2_T2 (SEQ ID NO:121). Table 1055 below describes the starting and ending position of this segment on each transcript.

TABLE 1055

Segment location on transcripts

| Transcript name | Segment starting position | Segment ending position |
|---|---|---|
| Z25299_PEA_2_T2 (SEQ ID NO: 121) | 518 | 707 |

Segment cluster Z25299_PEA_2_node_24 (SEQ ID NO:879) according to the present invention is supported by 2 libraries. The number of libraries was determined as previously described. This segment can be found in the following transcript(s): Z25299_PEA_2_T2 (SEQ ID NO:121) and Z25299_PEA_2_T3 (SEQ ID NO:122). Table 1056 below describes the starting and ending position of this segment on each transcript.

TABLE 1056

Segment location on transcripts

| Transcript name | Segment starting position | Segment ending position |
|---|---|---|
| Z25299_PEA_2_T2 (SEQ ID NO: 121) | 708 | 886 |
| Z25299_PEA_2_T3 (SEQ ID NO: 122) | 518 | 696 |

Segment cluster Z25299_PEA_2_node_8 (SEQ ID NO:880) according to the present invention is supported by 218 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122), Z25299_PEA_2_T6 (SEQ ID NO:123) and Z25299_PEA_2_T9 (SEQ ID NO:124). Table 1057 below describes the starting and ending position of this segment on each transcript.

TABLE 1057

Segment location on transcripts

| Transcript name | Segment starting position | Segment ending position |
|---|---|---|
| Z25299_PEA_2_T1 (SEQ ID NO: 120) | 1 | 208 |
| Z25299_PEA_2_T2 (SEQ ID NO: 121) | 1 | 208 |
| Z25299_PEA_2_T3 (SEQ ID NO: 122) | 1 | 208 |
| Z25299_PEA_2_T6 (SEQ ID NO: 123) | 1 | 208 |
| Z25299_PEA_2_T9 (SEQ ID NO: 124) | 1 | 208 |

According to an optional embodiment of the present invention, short segments related to the above cluster are also provided. These segments are up to about 120 bp in length, and so are included in a separate description.

Segment cluster Z25299_PEA_2_node_12 (SEQ ID NO:881) according to the present invention is supported by 228 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3, (SEQ ID NO:122), Z25299_PEA_2_T6 (SEQ ID NO:123) and Z25299_PEA_2_T9 (SEQ ID NO:124). Table 1058 below describes the starting and ending position of this segment on each transcript.

TABLE 1058

Segment location on transcripts

| Transcript name | Segment starting position | Segment ending position |
|---|---|---|
| Z25299_PEA_2_T1 (SEQ ID NO: 120) | 209 | 245 |
| Z25299_PEA_2_T2 (SEQ ID NO: 121) | 209 | 245 |
| Z25299_PEA_2_T3 (SEQ ID NO: 122) | 209 | 245 |
| Z25299_PEA_2_T6 (SEQ ID NO: 123) | 209 | 245 |
| Z25299_PEA_2_T9 (SEQ ID NO: 124) | 209 | 245 |

Segment cluster Z25299_PEA_2_node_13 (SEQ ID NO:882) according to the present invention is supported by 246 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122), Z25299_PEA_2_T6 (SEQ ID NO:123) and Z25299_PEA_2_T9 (SEQ ID NO:124). Table 1059 below describes the starting and ending position of this segment on each transcript.

TABLE 1059

Segment location on transcripts

| Transcript name | Segment starting position | Segment ending position |
|---|---|---|
| Z25299_PEA_2_T1 (SEQ ID NO: 120) | 246 | 357 |
| Z25299_PEA_2_T2 (SEQ ID NO: 121) | 246 | 357 |
| Z25299_PEA_2_T3 (SEQ ID NO: 122) | 246 | 357 |
| Z25299_PEA_2_T6 (SEQ ID NO: 123) | 246 | 357 |
| Z25299_PEA_2_T9 (SEQ ID NO: 124) | 246 | 357 |

Segment cluster Z25299_PEA_2_node_14 (SEQ ID NO:883) according to the present invention can be found in the following transcript(s): Z25299_PEA_2_T1 (SEQ ID NO:120), Z25299_PEA_2_T2 (SEQ ID NO:121), Z25299_PEA_2_T3 (SEQ ID NO:122), Z25299_PEA_2_T6 (SEQ ID NO:123) and Z25299_PEA_2_T9 (SEQ ID NO:124). Table 1060 below describes the starting and ending position of this segment on each transcript.

TABLE 1060

Segment location on transcripts

| Transcript name | Segment starting position | Segment ending position |
|---|---|---|
| Z25299_PEA_2_T1 (SEQ ID NO: 120) | 358 | 367 |

TABLE 1060-continued

Segment location on transcripts

| Transcript name | Segment starting position | Segment ending position |
|---|---|---|
| Z25299_PEA_2_T2 (SEQ ID NO: 121) | 358 | 367 |
| Z25299_PEA_2_T3 (SEQ ID NO: 122) | 358 | 367 |
| Z25299_PEA_2_T6 (SEQ ID NO: 123) | 358 | 367 |
| Z25299_PEA_2_T9 (SEQ ID NO: 124) | 358 | 367 |

Segment cluster Z25299_PEA_2_node_17 (SEQ ID NO:884) according to the present invention can be found in the following transcript(s): Z25299_PEA_2_T1 (SEQ ID NO:120), Z25299_PEA_2_T2 (SEQ ID NO:121) and Z25299_PEA_2_T3 (SEQ ID NO:122). Table 1061 below describes the starting and ending position of this segment on each transcript.

TABLE 1061

Segment location on transcripts

| Transcript name | Segment starting position | Segment ending position |
|---|---|---|
| Z25299_PEA_2_T1 (SEQ ID NO: 120) | 368 | 371 |
| Z25299_PEA_2_T2 (SEQ ID NO: 121) | 368 | 371 |
| Z25299_PEA_2_T3 (SEQ ID NO: 122) | 368 | 371 |

Segment cluster Z25299_PEA_2_node_18 (SEQ ID NO:885) according to the present invention is supported by 221 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122) and Z25299_PEA_2_T6 (SEQ ID NO:123). Table 1062 below describes the starting and ending position of this segment on each transcript.

TABLE 1062

Segment location on transcripts

| Transcript name | Segment starting position | Segment ending position |
|---|---|---|
| Z25299_PEA_2_T1 (SEQ ID NO: 120) | 372 | 427 |

TABLE 1062-continued

Segment location on transcripts

| Transcript name | Segment starting position | Segment ending position |
|---|---|---|
| Z25299_PEA_2_T2 (SEQ ID NO: 121) | 372 | 427 |
| Z25299_PEA_2_T3 (SEQ ID NO: 122) | 372 | 427 |
| Z25299_PEA_2_T6 (SEQ ID NO: 123) | 368 | 423 |

Segment cluster Z25299_PEA_2_node_19 (SEQ ID NO:886) according to the present invention is supported by 197 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122) and Z25299_PEA_2_T6 (SEQ ID NO:123). Table 1063 below describes the starting and ending position of this segment on each transcript.

TABLE 1063

Segment location on transcripts

| Transcript name | Segment starting position | Segment ending position |
|---|---|---|
| Z25299_PEA_2_T1 (SEQ ID NO: 120) | 428 | 517 |
| Z25299_PEA_2_T2 (SEQ ID NO: 121) | 428 | 517 |
| Z25299_PEA_2_T3 (SEQ ID NO: 122) | 428 | 517 |
| Z25299_PEA_2_T6 (SEQ ID NO: 123) | 424 | 513 |

Variant Protein Alignment to the Previously Known Protein:

Sequence name: /tmp/oXgeQ4MeyL/K6Vqb1MQu2: ALK1_HUMAN (SEQ ID NO:1454)

Sequence documentation:

Alignment of: Z25299_PEA_2_P2 (SEQ ID NO:1390) x ALK1_HUMAN (SEQ ID NO:1454) ..

Alignment segment 1/1:

| | | | |
|---|---|---|---|
| Quality: | 1371.00 | Escore: | 0 |
| Matching length: | 131 | Total length: | 131 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKSSGLFPPLVLLALGTLAPWAVEGSGKSFKAGVCPPKKSAQCLRYKKPE  50
    |||||||||||||||||||||||||||||||||||||||||||||||||
  1 MKSSGLFPPLVLLALGTLAPWAVEGSGKSFKAGVCPPKKSAQCLRYKKPE  50

51 CQSDWQCPGKKRCCPDTCGIKCLDPVDTPNPTRRKPGKCPVTYGQCLMLN 100
    |||||||||||||||||||||||||||||||||||||||||||||||||
 51 CQSDWQCPGKKRCCPDTCGIKCLDPVDTPNPTRRKPGKCPVTYGQCLMLN 100

101 PPNFCEMDGQCKRDLKCCMGMCGKSCVSPVK                   131
    |||||||||||||||||||||||||||||||
101 PPNFCEMDGQCKRDLKCCMGMCGKSCVSPVK                   131
```

Sequence name: /tmp/rbf314VLIm/yR43i4SbP4: ALK1_HUMAN (SEQ ID NO:1454)
Sequence documentation:
Alignment of: Z25299_PEA__2_P3 (SEQ ID NO:1391) x ALK1_HUMAN (SEQ ID NO:1454)..
Alignment segment 1/1:

| | | | |
|---|---|---|---|
| Quality: | 1371.00 | Escore: | 0 |
| Matching length: | 131 | Total length: | 131 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKSSGLFPPLVLLALGTLAPWAVEGSGKSFKAGVCPPKKSAQCLRYKKPE  50
    |||||||||||||||||||||||||||||||||||||||||||||||||
  1 MKSSGLFPPLVLLALGTLAPWAVEGSGKSFKAGVCPPKKSAQCLRYKKPE  50

51 CQSDWQCPGKKRCCPDTCGIKCLDPVDTPNPTRRKPGKCPVTYGQCLMLN 100
    |||||||||||||||||||||||||||||||||||||||||||||||||
 51 CQSDWQCPGKKRCCPDTCGIKCLDPVDTPNPTRRKPGKCPVTYGQCLMLN 100

101 PPNFCEMDGQCKRDLKCCMGMCGKSCVSPVK                   131
    |||||||||||||||||||||||||||||||
101 PPNFCEMDGQCKRDLKCCMGMCGKSCVSPVK                   131
```

Sequence name: /tmp/KCtSXACZXe/rK4T6LKeRX: ALK1_HUMAN (SEQ ID NO:1454)
Sequence documentation:
Alignment of: Z25299_PEA_2_P7 (SEQ ID NO:1392) x ALK1_HUMAN (SEQ ID NO:1454) ..
Alignment segment 1/1:

| | | | |
|---|---|---|---|
| Quality: | 835.00 | Escore: | 0 |
| Matching length: | 81 | Total length: | 81 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MKSSGLFPFLVLLALGTLAPWAVEGSGKSFKAGVCPPKKSAQCLRYKKPE 50
   |||||||||||||||||||||||||||||||||||||||||||||||||
 1 MKSSGLFPFLVLLALGTLAPWAVEGSGKSFKAGVCPPKKSAQCLRYKKPE 50

51 CQSDWQCPGKKRCCPDTCGIKCLDPVDTPNP                    81
   |||||||||||||||||||||||||||||||
51 CQSDWQCPGKKRCCPDTCGIKCLDPVDTPNP                    81
```

Sequence name: /tmp/LcBlcAxB6c/NSI9pqfxoU: ALK1_HUMAN (SEQ ID NO:1454)
Sequence documentation:
Alignment of: Z25299_PEA_2_P10 (SEQ ID NO:1393) x ALK1_HUMAN (SEQ ID NO:1454) ..
Alignment segment 1/1:

| | | | |
|---|---|---|---|
| Quality: | 844.00 | Escore: | 0 |
| Matching length: | 82 | Total length: | 82 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MKSSGLFPFLVLLALGTLAPWAVEGSGKSFKAGVCPPKKSAQCLRYKKPE 50
   |||||||||||||||||||||||||||||||||||||||||||||||||
 1 MKSSGLFPFLVLLALGTLAPWAVEGSGKSFKAGVCPPKKSAQCLRYKKPE 50

51 CQSDWQCPGKKRCCPDTCGIKCLDPVDTPNPT                   82
   ||||||||||||||||||||||||||||||||
51 CQSDWQCPGKKRCCPDTCGIKCLDPVDTPNPT                   82
```

Expression of Secretory Leukocyte Protease Inhibitor Acid-stable Proteinase Inhibitor Z25299 Transcripts, which are Detectable by Amplicon as Depicted in Sequence Name Z25299 junc13-14-21 (SEQ ID NO: 1666) in Normal and Cancerous Lung Tissues Expression of Secretory leukocyte protease inhibitor Acid-stable proteinase inhibitor transcripts detectable by or according to junc13-14-21, Z25299junc13-14-21 amplicon (SEQ ID NO: 1666) and Z25299junc13-14-21F (SEQ ID NO:1664) and Z25299junc13-14-21R (SEQ ID NO:1665) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2 "Tissue sample in testing panel", above), to obtain a value of fold differential expression for each sample relative to median of the normal PM samples.

Figure 36:
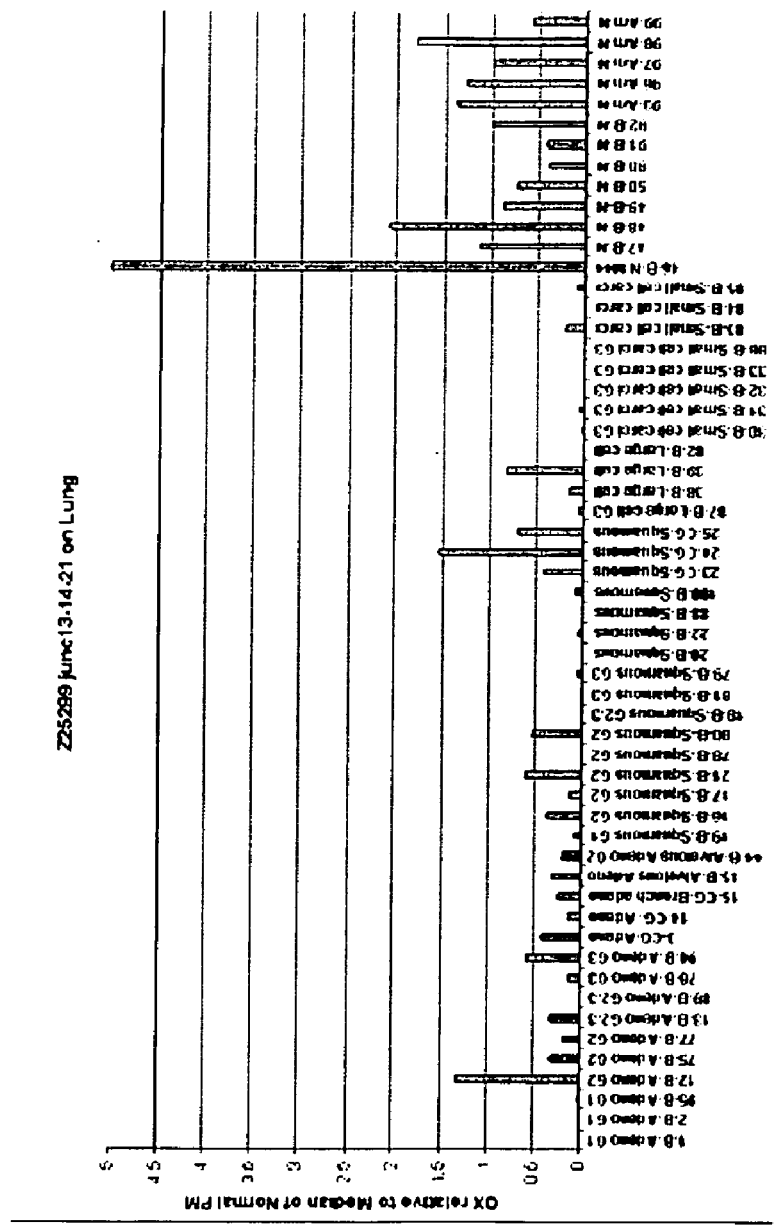
FIG. 36 is a histogram showing down regulation of the Secretory leukocyte protease inhibitor Acid-stable proteinase inhibitor Z25299 transcripts, which are detectable by amplicon as depicted in sequence name Z25299 junc13-14-21 (SEQ ID NO: 1666), in cancerous lung samples relative to the normal samples.

FIG. 36 is a histogram showing down regulation of the above-indicated Secretory leukocyte protease inhibitor Acid-stable proteinase inhibitor transcripts in cancerous lung samples relative to the normal samples.

As is evident from FIG. 36, the expression of Secretory leukocyte protease inhibitor Acid-stable proteinase inhibitor transcripts detectable by the above amplicon(s) in cancer samples was significantly lower than in the non-cancerous samples (Sample Nos. 47-50, 90-93, 96-99 Table 2, "Tissue sample in testing panel").

Statistical analysis was applied to verify the significance of these results, as described below.

The P value for the difference in the expression levels of Secretory leukocyte protease inhibitor Acid-stable proteinase inhibitor transcripts detectable by the above amplicon(s) in lung cancer samples versus the normal tissue samples was determined by T test as 1.98E-04. This value demonstrates statistical significance of the results.

Primer pairs are also optionally and preferably encompassed within the present invention; for example, for the above experiment, the following primer pair was used as a non-limiting illustrative example only of a suitable primer pair: Z25299 junc13-14-21F forward primer (SEQ ID NO: 1664); and Z25299 junc13-14-21R reverse primer (SEQ ID NO: 1665).

The present invention also preferably encompasses any amplicon obtained through the use of any suitable primer pair; for example, for the above experiment, the following amplicon was obtained as a non-limiting illustrative example only of a suitable amplicon: Z25299 junc13-14-21 (SEQ ID NO: 1666).

```
Forward primer:  (SEQ ID NO: 1664)
ACCCCAAACCCAACTTGATTC

Reverse primer:  (SEQ ID NO: 1665)
TCAGTGGTGGAGCCAAGTCTC

Amplicon:        (SEQ ID NO: 1666)
ACCCCAAACCCAACTTGATTCCTGCCATATGGAGGAGGCTCTGGAGTCCTGCTCTGT

GTGGTCCAGGTCCTTTCCACCCTGAGACTTGGCTCCACCACTGA
```

Z25299 Transcripts, which are Detectable by Amplicon as Depicted in Sequence Name Z25299 Seg20 (SEQ ID NO: 1669) in Normal and Cancerous Lung Tissues Expression of Secretory leukocyte protease inhibitor Acid-stable proteinase inhibitor transcripts detectable by or according to seg20, Z25299 seg20 amplicon (SEQ ID NO:1669) and Z25299 seg20F (SEQ ID NO:1667) and Z25299 seg20R (SEQ ID NO:1668) primers was measured by real time PCR. In parallel the expression of four housekeeping genes— PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above). Then the reciprocal of this ratio was calculated, to obtain a value of fold down-regulation for each sample relative to median of the normal PM samples.

Figure 37:
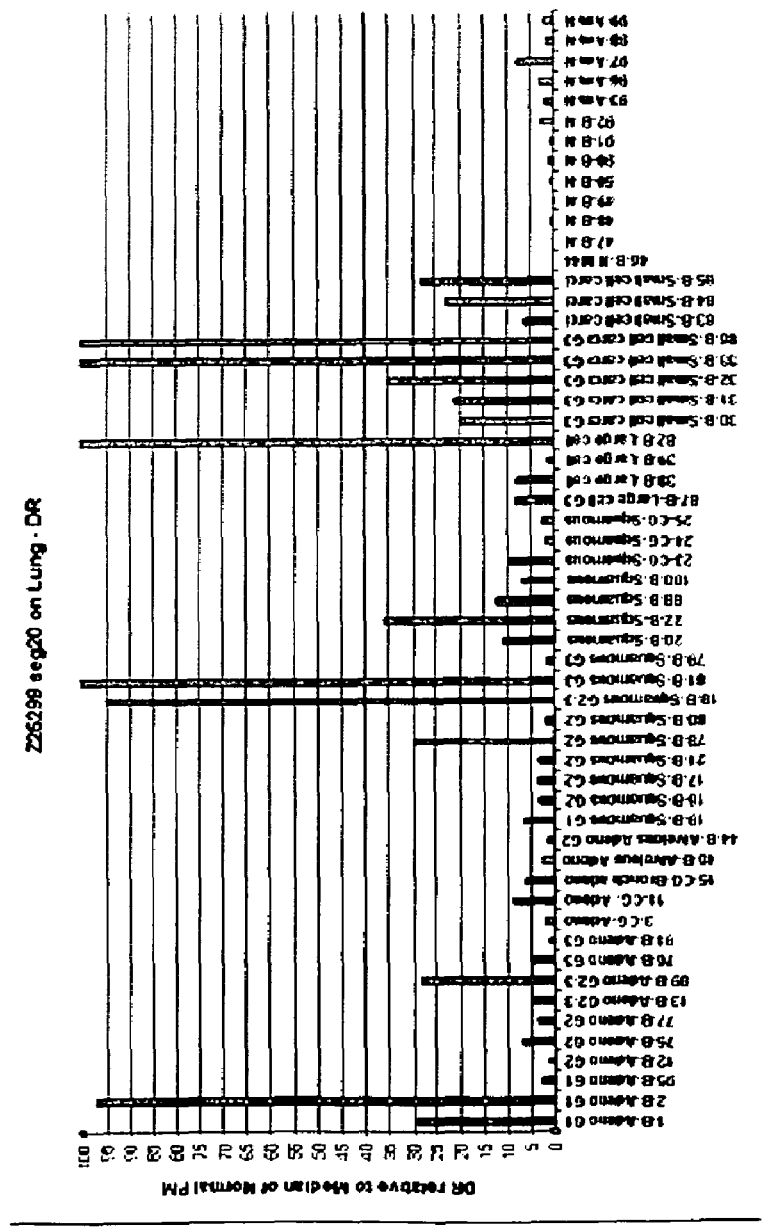
FIG. 37 is a histogram showing down regulation of the Secretory leukocyte protease inhibitor Acid-stable proteinase inhibitor Z25299 transcripts, which are detectable by amplicon as depicted in sequence name Z25299 seg20 (SEQ ID NO: 1669), in cancerous lung samples relative to the normal samples.

FIG. 37 is a histogram showing down regulation of the above-indicated Secretory leukocyte protease inhibitor Acid-stable proteinase inhibitor transcripts in cancerous lung samples relative to the normal samples. The number and percentage of samples that exhibit at least 5 fold down regulation, out of the total number of samples tested is indicated in the bottom.

As is evident from FIG. 37, the expression of Secretory leukocyte protease inhibitor Acid-stable proteinase inhibitor transcripts detectable by the above amplicon(s) in cancer samples was significantly lower than in the non-cancerous samples (Sample Nos. 47-50, 90-93, 96-99 Table 2, "Tissue sample in testing panel"). Notably an down regulation of at least 5 fold was found in 6 out of 15 adenocarcinoma samples, 9 out of 16 squamous cell carcinoma samples, 3 out of 4 large cell carcinoma samples and in 8 out of 8 small cell carcinoma samples.

Statistical analysis was applied to verify the significance of these results, as described below.

The P value for the difference in the expression levels of Secretory leukocyte protease inhibitor Acid-stable proteinase inhibitor transcripts detectable by the above amplicon(s) in lung cancer samples versus the normal tissue samples was determined by T test as 9.43E-02 in adenocarcinoma, 5.62E-02 in squamous cell carcinoma, 3.38E-01 in large cell carcinoma and 3.78E-02 in small cell carcinoma.

Threshold of 5 fold down regulation was found to differentiate between cancer and normal samples with P value of 3.73E-02 in adenocarcinoma, 1.10E-02 in squamous cell carcinoma, 2.64E-02 in large cell carcinoma and 7.14E-05 in small cell carcinoma checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z25299 seg20F forward primer (SEQ ID NO:1667); and Z25299 seg20R reverse primer (SEQ ID NO:1668).

The present invention also preferably encompasses any amplicon obtained through the use of any suitable primer pair; for example, for the above experiment, the following amplicon was obtained as a non-limiting illustrative example only of a suitable amplicon: Z25299 seg20 (SEQ ID NO: 1669).

```
Forward primer:  (SEQ ID NO: 1667)
CTCCTGAACCCTACTCCAAGCA

Reverse primer:  (SEQ ID NO: 1668)
CAGGCGATCCTATGGAAATCC
```

```
Amplicon:      (SEQ ID NO: 1669)
CTCCTGAACCCTACTCCAAGCACAGCCTCTGTCTGACTCCCTTGTCCTTCAAGAGAA

CTGTTCTCCAGGTCTCAGGGCCAGGATTTCCATAGGATCGCCTG
```

Expression of Homo sapiens Secretory Leukocyte Protease Inhibitor (Antileukoproteinase) (SLPI) Z25299 Transcripts which are Detectable by Amplicon as Depicted in Sequence Name Z25299 Seg23 (SEQ ID NO: 1672) in Normal and Cancerous Lung Tissues Expression of Homo sapiens secretory leukocyte protease inhibitor (antileukoproteinase) (SLPI) transcripts detectable by or according to seg23, Z25299 seg23 amplicon (SEQ ID NO: 1672) and primers Z25299 seg23F (SEQ ID NO:1670) and Z25299 seg23R (SEQ ID NO: 1671) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above). Then the reciprocal of this ratio was calculated, to obtain a value of fold down-regulation for each sample relative to median of the normal PM samples.

Figure 68:
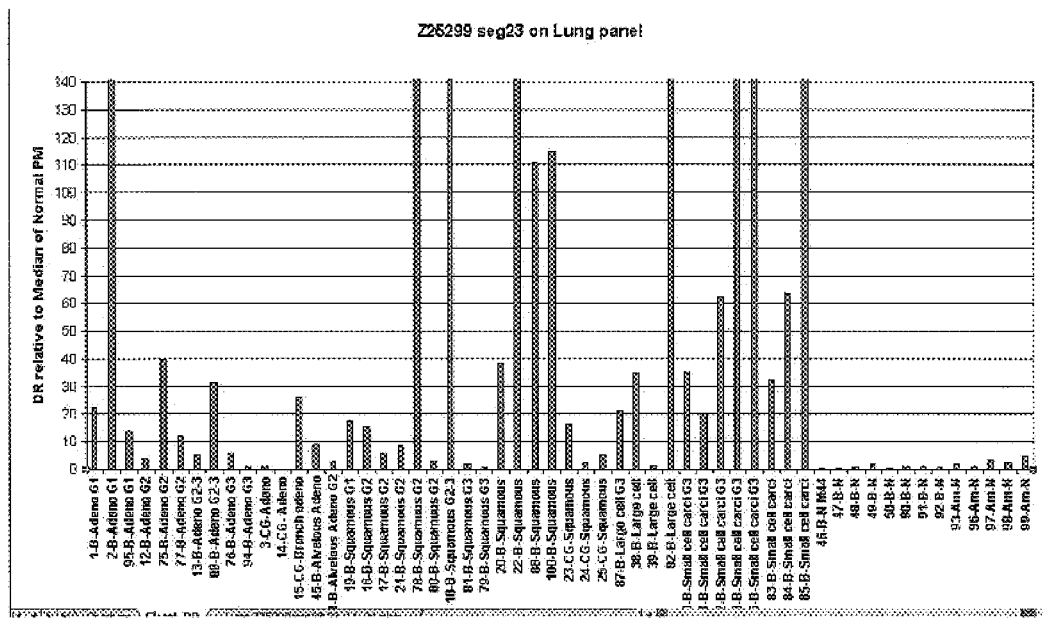
FIG. 68 is a histogram showing down regulation of the *Homo sapiens* secretory leukocyte protease inhibitor (anti-leukoproteinase) (SLPI) Z25299 transcripts which are detectable by amplicon as depicted in sequence name Z25299 seg23 (SEQ ID NO: 1672) in cancerous lung samples relative to the normal samples.

FIG. 68 is a histogram showing down regulation of the above-indicated Homo sapiens secretory leukocyte protease inhibitor (antileukoproteinase) (SLPI) transcripts in cancerous lung samples relative to the normal samples.

As is evident from FIG. 68, the expression of Homo sapiens secretory leukocyte protease inhibitor (antileukoproteinase) (SLPI) transcripts detectable by the above amplicon(s) in cancer samples was significantly lower than in the non-cancerous samples (Sample Nos. 46-50, 90-93, 96-99 Table 2). Notably down regulation of at least 10 fold was found in 7 out of 15 adenocarcinoma samples, 9 out of 16 squamous cell carcinoma samples, 3 out of 4 large cell carcinoma samples and in 8 out of 8 small cells carcinoma samples.

Primer pairs are also optionally and preferably encompassed within the present invention; for example, for the above experiment, the following primer pair was used as a non-limiting illustrative example only of a suitable primer pair: Z25299 seg23F forward primer (SEQ ID NO: 1670); and Z25299 seg23R reverse primer (SEQ ID NO: 1671).

The present invention also preferably encompasses any amplicon obtained through the use of any suitable primer pair; for example, for the above experiment, the following amplicon was obtained as a non-limiting illustrative example only of a suitable amplicon: Z25299 seg23 (SEQ ID NO: 1672).

Primers:

```
Forward primer Z25299 seg23F:  (SEQ ID NO: 1670)
CAAGCAATTGAGGGACCAGG

Reverse primer Z25299 seg23R:  (SEQ ID NO: 1671)
CAAAAAACATTGTTAATGAGAGAGATGAC

Amplicon Z25299 seg23F:        (SEQ ID NO: 1672)
CAAGCAATTGAGGGACCAGGAAGTGGATCCTCTAGAGATGAGGAGGCATTCTGCTG

GATGACTTTTAAAAATGTTTTCTCCAGAGTCATCTCTCTCATTAACAATGTTTTTG
```

Expression of Secretory Leukocyte Protease Inhibitor Acid-stable Proteinase Inhibitor Z25299 Transcripts which are Detectable by Amplicon as Depicted in Sequence Name Z25299seg20 (SEQ ID NO: 1669) in Different Normal Tissues Expression of Secretory leukocyte protease inhibitor transcripts detectable by or according to Z25299seg20 amplicon (SEQ ID NO: 1669) and primers: Z25299seg23F (SEQ ID NO: 1667) Z25299seg20R (SEQ ID NO: 1668) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 3), to obtain a value of relative expression of each sample relative to median of the ovary samples.

Primers:

```
Forward primer:  (SEQ ID NO: 1667)
CTCCTGAACCCTACTCCAAGCA

Reverse primer:  (SEQ ID NO: 1668)
CAGGCGATCCTATGGAAATCC

Amplicon:        (SEQ ID NO: 1669)
CTCCTGAACCCTACTCCAAGCACAGCCTCTGTCTGACTCCCTTGTCCTTCAAGAGAA

CTGTTCTCCAGGTCTCAGGGCCAGGATTTCCATAGGATCGCCTG
```

Figure 69:
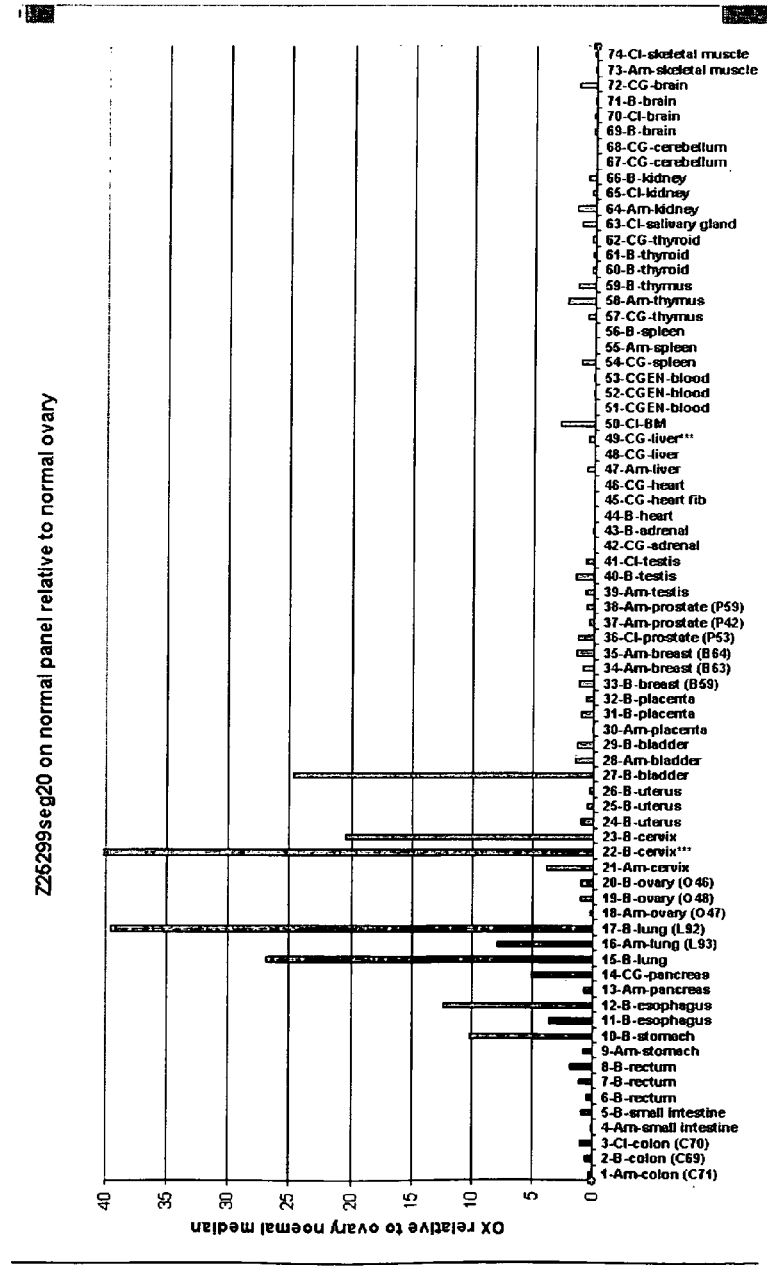
FIG. 69 is a histogram showing the expression of Secretory leukocyte protease inhibitor Acid-stable proteinase inhibitor Z25299 transcripts which are detectable by amplicon as depicted in sequence name Z25299seg20 (SEQ ID NO: 1669) in different normal tissues.

The results are demonstrated in FIG. 69, showing the expression of Secretory leukocyte protease inhibitor Acid-stable proteinase inhibitor Z25299 transcripts which are detectable by amplicon as depicted in sequence name Z25299seg20 (SEQ ID NO: 1669) in different normal tissues.

Expression of Secretory Leukocyte Protease Inhibitor Z25299 Transcripts which are Detectable by Amplicon as Depicted in Sequence Name Z25299seg23 (SEQ ID NO: 1672) in Different Normal Tissues Expression of Secretory leukocyte protease inhibitor transcripts detectable by or according to Z25299seg23 amplicon (SEQ ID NO: 1672) and primers: Z25299seg23F (SEQ ID NO: 1670) Z25299seg23R (SEQ ID NO: 1671) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 3), to obtain a value of relative expression of each sample relative to median of the ovary samples.

Primers:

detectable by amplicon as depicted in sequence name Z25299seg23 (SEQ ID NO: 1672) in different normal tissues.

Description for Cluster HSSTROL3

Cluster HSSTROL3 features 6 transcript(s) and 16 segment(s) of interest, the names for which are given in Tables 1064 and 1065, respectively, the sequences themselves are given at the end of the application. The selected protein variants are given in table 1066.

TABLE 1064

| Transcripts of interest | |
| --- | --- |
| Transcript Name | Sequence ID No. |
| HSSTROL3_T5 | 125 |
| HSSTROL3_T8 | 126 |
| HSSTROL3_T9 | 127 |
| HSSTROL3_T10 | 128 |
| HSSTROL3_T11 | 129 |
| HSSTROL3_T12 | 130 |

TABLE 1065

| Segments of interest | |
| --- | --- |
| Segment Name | Sequence ID No. |
| HSSTROL3_node_6 | 887 |
| HSSTROL3_node_10 | 888 |
| HSSTROL3_node_13 | 889 |
| HSSTROL3_node_15 | 890 |
| HSSTROL3_node_19 | 891 |
| HSSTROL3_node_21 | 892 |

```
Forward primer Z25299 seg23F: (SEQ ID NO: 1670)
CAAGCAATTGAGGGACCAGG

Reverse primer Z25299 seg23R: (SEQ ID NO: 1671)
CAAAAAACATTGTTAATGAGAGAGATGAC

Amplicon Z25299 seg23F:       (SEQ ID NO: 1672)
CAAGCAATTGAGGGACCAGGAAGTGGATCCTCTAGAGATGAGGAGGCATTCTGCTG

GATGACTTTTAAAAATGTTTTCTCCAGAGTCATCTCTCTCATTAACAATGTTTTTG
```

Figure 70:
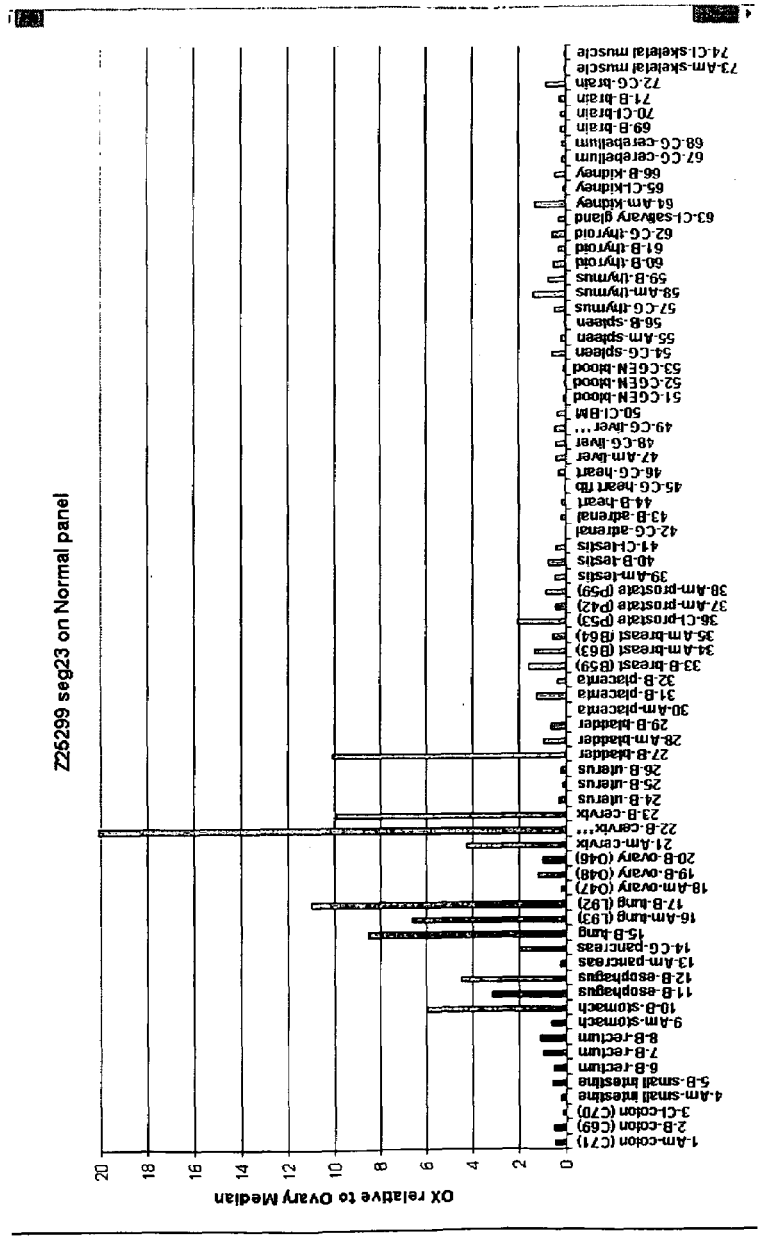
FIG. 70 is a histogram showing the expression of Secretory leukocyte protease inhibitor Acid-stable proteinase inhibitor Z25299 transcripts which are detectable by amplicon as depicted in sequence name Z25299seg23 (SEQ ID NO:1672) in different normal tissues.

The results are demonstrated in FIG. 70, showing the expression of Secretory leukocyte protease inhibitor Acid-stable proteinase inhibitor Z25299 transcripts which are TABLE 1065-continued Segments of interest

| Segment Name | Sequence ID No. |
|---|---|
| HSSTROL3_node_24 | 893 |
| HSSTROL3_node_25 | 894 |
| HSSTROL3_node_26 | 895 |
| HSSTROL3_node_28 | 896 |
| HSSTROL3_node_29 | 897 |
| HSSTROL3_node_11 | 898 |
| HSSTROL3_node_17 | 899 |
| HSSTROL3_node_18 | 900 |
| HSSTROL3_node_20 | 901 |
| HSSTROL3_node_27 | 902 |

TABLE 1066

Proteins of interest

| Protein Name | Sequence ID No. | Corresponding Transcript(s) |
|---|---|---|
| HSSTROL3_P4 | 1394 | HSSTROL3_T5 (SEQ ID NO: 125) |
| HSSTROL3_P5 | 1395 | HSSTROL3_T8 (SEQ ID NO: 126); HSSTROL3_T9 (SEQ ID NO: 127) |
| HSSTROL3_P7 | 1396 | HSSTROL3_T10 (SEQ ID NO: 128) |
| HSSTROL3_P8 | 1397 | HSSTROL3_T11 (SEQ ID NO: 129) |
| HSSTROL3_P9 | 1398 | HSSTROL3_T12 (SEQ ID NO: 130) |

These sequences are variants of the known protein Stromelysin-3 Precursor (SwissProt accession identifier MM11_HUMAN; known also according to the synonyms EC 3.4.24.-; Matrix metalloproteinase-11; MMP-11; ST3; SL-3), SEQ ID NO:1455, referred to herein as the previously known protein.

Protein Stromelysin-3 Precursor (SEQ ID NO:1455) is known or believed to have the following function(s): May play an important role in the progression of epithelial malignancies. The sequence for protein Stromelysin-3 Precursor is given at the end of the application, as "Stromelysin-3 Precursor amino acid sequence".

The following GO Annotation(s) apply to the previously known protein. The following annotation(s) were found: proteolysis and peptidolysis; developmental processes; morphogenesis, which are annotation(s) related to Biological Process; stromelysin 3; calcium binding; zinc binding; hydrolase, which are annotation(s) related to Molecular Function; and extracellular matrix, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

Cluster HSSTROL3 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 38 refer to weighted expression of ESTs in each category, as "parts per million" (ratio of the expression of ESTs for a particular cluster to the expression of all ESTs in that category, according to parts per million).

Figure 38:
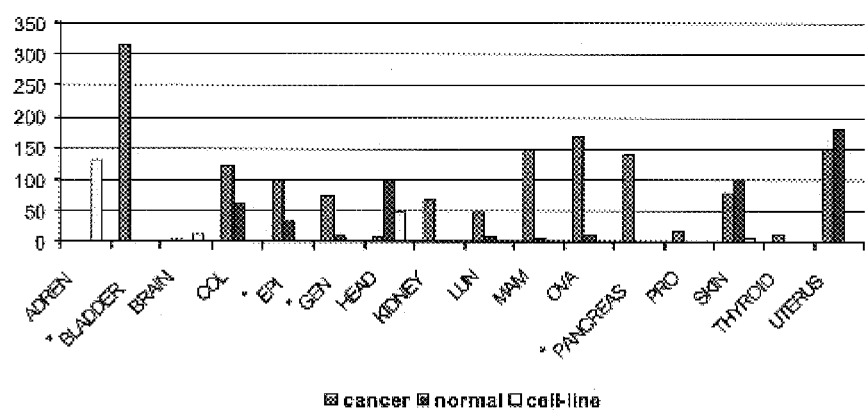
FIG. 38 is a histogram showing Cancer and cell-line vs. normal tissue expression for Cluster HSSTROL3, demonstrating overexpression in transitional cell carcinoma, epithelial malignant tumors, a mixture of malignant tumors from different tissues and pancreas carcinoma.

Overall, the following results were obtained as shown with regard to the histograms in FIG. 38 and Table 1067. This cluster is overexpressed (at least at a minimum level) in the following pathological conditions: transitional cell carcinoma, epithelial malignant tumors, a mixture of malignant tumors from different tissues and pancreas carcinoma.

TABLE 1067

Normal tissue distribution

| Name of Tissue | Number |
|---|---|
| adrenal | 0 |
| bladder | 0 |
| brain | 1 |
| colon | 63 |
| epithelial | 33 |
| general | 13 |
| head and neck | 101 |
| kidney | 0 |
| lung | 11 |
| breast | 8 |
| ovary | 14 |
| pancreas | 0 |
| prostate | 2 |
| skin | 99 |
| Thyroid | 0 |
| uterus | 181 |

TABLE 1068

P values and ratios for expression in cancerous tissue

| Name of Tissue | P1 | P2 | SP1 | R3 | SP2 | R4 |
|---|---|---|---|---|---|---|
| adrenal | 1 | 4.6e−01 | 1 | 1.0 | 5.3e−01 | 1.9 |
| bladder | 2.7e−01 | 3.4e−01 | 3.3e−03 | 4.9 | 2.1e−02 | 3.3 |
| brain | 3.5e−01 | 2.6e−01 | 1 | 1.7 | 3.3e−01 | 2.8 |
| colon | 7.7e−02 | 1.5e−01 | 3.1e−01 | 1.4 | 5.2e−01 | 1.0 |
| epithelial | 1.2e−04 | 1.2e−02 | 1.3e−06 | 2.7 | 4.6e−02 | 1.4 |
| general | 5.4e−09 | 3.1e−05 | 1.8e−16 | 5.0 | 3.1e−07 | 2.6 |
| head and neck | 4.6e−01 | 4.3e−01 | 1 | 0.6 | 9.4e−01 | 0.7 |
| kidney | 2.5e−01 | 3.5e−01 | 1.1e−01 | 4.0 | 2.4e−01 | 2.8 |
| lung | 1.8e−01 | 4.5e−01 | 1.9e−01 | 2.7 | 5.1e−01 | 1.4 |
| breast | 2.0e−01 | 3.4e−01 | 7.3e−02 | 3.3 | 2.5e−01 | 2.0 |
| ovary | 2.6e−01 | 3.2e−01 | 2.2e−02 | 2.0 | 7.0e−02 | 1.6 |
| pancreas | 9.5e−02 | 1.8e−01 | 1.8e−04 | 7.8 | 1.6e−03 | 5.5 |
| prostate | 8.2e−01 | 7.8e−01 | 4.5e−01 | 1.8 | 5.6e−01 | 1.5 |
| skin | 5.2e−01 | 5.8e−01 | 7.1e−01 | 0.8 | 1 | 0.3 |
| Thyroid | 2.9e−01 | 2.9e−01 | 1 | 1.1 | 1 | 1.1 |
| uterus | 4.2e−01 | 8.0e−01 | 7.5e−01 | 0.6 | 9.9e−01 | 0.4 |

As noted above, cluster HSSTROL3 features 6 transcript(s), which were listed in Table 1 above. These transcript(s) encode for protein(s) which are variant(s) of protein Stromelysin-3 precursor (SEQ ID NO:1455). A description of each variant protein according to the present invention is now provided.

Variant protein HSSTROL3_P4 (SEQ ID NO:1394) according to the present invention has an amino acid sequence as given at the end of the application; it is encoded by transcript(s) HSSTROL3_T5 (SEQ ID NO:125). An alignment is given to the known protein (Stromelysin-3 precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison Report Between HSSTROL3_P4 (SEQ ID NO:1394) and MM11_HUMAN (SEQ ID NO:1455):

1. An isolated chimeric polypeptide encoding for HSSTROL3_P4 (SEQ ID NO:1394), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:1455), which also corresponds to amino acids 1-163 of HSSTROL3_P4 (SEQ ID NO:1394), a bridging amino acid H corresponding to amino acid 164 of HSSTROL3_P4 (SEQ ID NO:1394), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQGAQY-WVYDGEKPVLGPAPLTELGLVRFPVHAALVWGPE KNKIYFFRGRDYWRFHPSTRRVD-SPVPRRATDWRGVPSEIDAAFQDADG corresponding to amino acids 165-445 of MM11_HUMAN (SEQ ID NO:1455), which also corresponds to amino acids 165-445 of HSSTROL3_P4 (SEQ ID NO:1394), and a third amino acid sequence being at least 70%, optionally at least 80%, preferably at least 85%, more preferably at least 90% and most preferably at least 95% homologous to a polypeptide having the sequence ALGVRQLVGGGHSSRFSHLVVAGL-PHACHRKSGSSSQVLCPEPSALLSVAG (SEQ ID NO: 251) corresponding to amino acids 446-496 of HSSTROL3_P4 (SEQ ID NO:1394), wherein said first amino acid sequence, bridging amino acid, second amino acid sequence and third amino acid sequence are contiguous and in a sequential order.

2. An isolated polypeptide encoding for a tail of HSSTROL3_P4 (SEQ ID NO:1394), comprising a polypeptide being at least 70%, optionally at least about 80%, preferably at least about 85%, more preferably at least about 90% and most preferably at least about 95% homologous to the sequence ALGVRQLVGGGHSSRFSHLVVAGL-PHACHRKSGSSSQVLCPEPSALLSVAG (SEQ ID NO: 251) in HSSTROL3_P4 (SEQ ID NO:1394).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P4 (SEQ ID NO:1394) also has the following non-silent SNPs (Single Nucleotide Polymorphisms) as listed in Table 1069, (given according to their position(s) on the amino acid sequence, with the alternative amino acid(s) listed; the last column indicates whether the SNP is known or not; the presence of known SNPs in variant protein HSSTROL3_P4 (SEQ ID NO:1394) sequence provides support for the deduced sequence of this variant protein according to the present invention).

TABLE 1069

Amino acid mutations

| SNP position(s) on amino acid sequence | Alternative amino acid(s) | Previously known SNP? |
|---|---|---|
| 38 | V -> A | Yes |
| 104 | R -> P | Yes |
| 214 | A -> | No |
| 323 | Q -> H | Yes |

Variant protein HSSTROL3_P4 (SEQ ID NO:1394) is encoded by the following transcript(s): HSSTROL3_T5 (SEQ ID NO:125), for which the sequence(s) is/are given at the end of the application. The coding portion of transcript HSSTROL3_T5 (SEQ ID NO:125) is shown in bold; this coding portion starts at position 24 and ends at position 1511. The transcript also has the following SNPs as listed in Table 1070 (given according to their position on the nucleotide sequence, with the alternative nucleic acid listed; the last column indicates whether the SNP is known or not; the presence of known SNPs in variant protein HSSTROL3_P4 (SEQ ID NO:1394) sequence provides support for the deduced sequence of this variant protein according to the present invention).

TABLE 1070

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 992 | G -> C | Yes |
| 1528 | A -> G | Yes |
| 1710 | A -> G | Yes |
| 2251 | A -> G | Yes |
| 2392 | C -> | No |
| 2444 | C -> A | Yes |
| 2470 | A -> T | Yes |
| 2687 | -> G | No |
| 2696 | -> G | No |
| 2710 | C -> | No |
| 2729 | -> A | No |
| 2755 | T -> C | No |
| 2813 | A -> | No |
| 2813 | A -> C | No |
| 2963 | A -> | No |
| 2963 | A -> C | No |
| 2993 | T -> C | Yes |
| 3140 | -> T | No |

Variant protein HSSTROL3_P5 (SEQ ID NO:1395) according to the present invention has an amino acid sequence as given at the end of the application; it is encoded by transcript(s) HSSTROL3_T8 (SEQ ID NO:126) and HSSTROL3_T9 (SEQ ID NO:127). An alignment is given to the known protein (Stromelysin-3 Precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison Report Between HSSTROL3_P5 (SEQ ID NO:1395) and MM11_HUMAN (SEQ ID NO:1455):

1. An isolated chimeric polypeptide encoding for HSSTROL3_P5 (SEQ ID NO:1395), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:1455), which also corresponds to amino acids 1-163 of HSSTROL3_P5 (SEQ ID NO:1395), a bridging amino acid H corresponding to amino acid 164 of HSSTROL3_P5 (SEQ ID NO:1395), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQ corresponding to amino acids 165-358 of MM11_HUMAN (SEQ ID NO:1455), which also corresponds to amino acids 165-358 of HSSTROL3_P5 (SEQ ID NO:1395), and a third amino acid sequence being at least 70%, optionally at least 80%, preferably at least 85%, more preferably at least 90% and most preferably at least 95% homologous to a polypeptide having the sequence ELGF-PSSTGRDESLEHCRCQGLHK (SEQ ID NO: 252) corresponding to amino acids 359-382 of HSSTROL3_P5 (SEQ ID NO:1395), wherein said first amino acid sequence, bridging amino acid, second amino acid sequence and third amino acid sequence are contiguous and in a sequential order.

2. An isolated polypeptide encoding for a tail of HSSTROL3_P5 (SEQ ID NO:1395), comprising a polypeptide being at least 70%, optionally at least about 80%, preferably at least about 85%, more preferably at least about 90% and most preferably at least about 95% homologous to the sequence ELGFPSSTGRDESLEHCRCQGLHK (SEQ ID NO: 252) in HSSTROL3_P5 (SEQ ID NO:1395).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3 P5 (SEQ ID NO:1395) also has the following non-silent SNPs (Single Nucleotide Polymorphisms) as listed in Table 1071, (given according to their position(s) on the amino acid sequence, with the alternative amino acid(s) listed; the last column indicates whether the SNP is known or not; the presence of known SNPs in variant protein HSSTROL3_P5 (SEQ ID NO:1395) sequence provides support for the deduced sequence of this variant protein according to the present invention).

TABLE 1071

| Amino acid mutations | | |
|---|---|---|
| SNP position(s) on amino acid sequence | Alternative amino acid(s) | Previously known SNP? |
| 38 | V -> A | Yes |
| 104 | R -> P | Yes |

TABLE 1071-continued

| Amino acid mutations | | |
|---|---|---|
| SNP position(s) on amino acid sequence | Alternative amino acid(s) | Previously known SNP? |
| 214 | A -> | No |
| 323 | Q -> H | Yes |

Variant protein HSSTROL3_P5 (SEQ ID NO:1395) is encoded by the following transcript(s): HSSTROL3_T8 (SEQ ID NO:126) and HSSTROL3_T9 (SEQ ID NO:127), for which the sequence(s) is/are given at the end of the application.

The coding portion of transcript HSSTROL3_T8 (SEQ ID NO:126) is shown in bold; this coding portion starts at position 24 and ends at position 1169. The transcript also has the following SNPs as listed in Table 1072 (given according to their position on the nucleotide sequence, with the alternative nucleic acid listed; the last column indicates whether the SNP is known or not; the presence of known SNPs in variant protein HSSTROL3_P5 (SEQ ID NO:1395) sequence provides support for the deduced sequence of this variant protein according to the present invention).

TABLE 1072

| Nucleic acid SNPs | | |
|---|---|---|
| SNP position on nucleotide sequence | Alternative nucleic acid | Previously known SNP? |
| 136 | T -> C | Yes |
| 334 | G -> C | Yes |
| 663 | G -> | No |
| 699 | -> T | No |
| 992 | G -> C | Yes |
| 1903 | C -> | No |
| 1955 | C -> A | Yes |
| 1981 | A -> T | Yes |
| 2198 | -> G | No |
| 2207 | -> G | No |
| 2221 | C -> | No |
| 2240 | -> A | No |
| 2266 | T -> C | No |
| 2324 | A -> | No |
| 2324 | A -> C | No |
| 2474 | A -> | No |
| 2474 | A -> C | No |
| 2504 | T -> C | Yes |
| 2651 | -> T | No |

The coding portion of transcript HSSTROL3_T9 (SEQ ID NO:127) is shown in bold; this coding portion starts at position 24 and ends at position 1169. The transcript also has the following SNPs as listed in Table 1073 (given according to their position on the nucleotide sequence, with the alternative nucleic acid listed; the last column indicates whether the SNP is known or not; the presence of known SNPs in variant protein HSSTROL3_P5 (SEQ ID NO:1395) sequence provides support for the deduced sequence of this variant protein according to the present invention).

TABLE 1073

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 992 | G -> C | Yes |
| 1666 | A -> G | Yes |
| 1848 | A -> G | Yes |
| 2389 | A -> G | Yes |
| 2530 | C -> | No |
| 2582 | C -> A | Yes |
| 2608 | A -> T | Yes |
| 2825 | -> G | No |
| 2834 | -> G | No |
| 2848 | C -> | No |
| 2867 | -> A | No |
| 2893 | T -> C | No |
| 2951 | A -> | No |
| 2951 | A -> C | No |
| 3101 | A -> | No |
| 3101 | A -> C | No |
| 3131 | T -> C | Yes |
| 3278 | -> T | No |

Variant protein HSSTROL3_P7 (SEQ ID NO:1396) according to the present invention has an amino acid sequence as given at the end of the application; it is encoded by transcript(s) HSSTROL3_T10 (SEQ ID NO:128). An alignment is given to the known protein (Stromelysin-3 Precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison Report Between HSSTROL3_P7 (SEQ ID NO:1396) and MM11_HUMAN (SEQ ID NO:1455):

1. An isolated chimeric polypeptide encoding for HSSTROL3_P7 (SEQ ID NO:1396), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:1455), which also corresponds to amino acids 1-163 of HSSTROL3_P7 (SEQ ID NO:1396), a bridging amino acid H corresponding to amino acid 164 of HSSTROL3_P7 (SEQ ID NO:1396), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLEPDAPPDACEASFDAVSTIRGEL-FFFKAGFVWRLRGGQLQPGYPALASRHWQGL PSPVDAAFEDAQGHIWFFQG corresponding to amino acids 165-359 of MM11_HUMAN (SEQ ID NO:1455), which also corresponds to amino acids 165-359 of HSSTROL3_P7 (SEQ ID NO:1396), and a third amino acid sequence being at least 70%, optionally at least 80%, preferably at least 85%, more preferably at least 90% and most preferably at least 95% homologous to a polypeptide having the sequence TTGVSTPAPGV (SEQ ID NO: 253) corresponding to amino acids 360-370 of HSSTROL3_P7 (SEQ ID NO:1396), wherein said first amino acid sequence, bridging amino acid, second amino acid sequence and third amino acid sequence are contiguous and in a sequential order.

2. An isolated polypeptide encoding for a tail of HSSTROL3_P7 (SEQ ID NO:1396), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P7 (SEQ ID NO:1396).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P7 (SEQ ID NO:1396) also has the following non-silent SNPs (Single Nucleotide Polymorphisms) as listed in Table 1074, (given according to their position(s) on the amino acid sequence, with the alternative amino acid(s) listed; the last column indicates whether the SNP is known or not; the presence of known SNPs in variant protein HSSTROL3_P7 (SEQ ID NO:1396) sequence provides support for the deduced sequence of this variant protein according to the present invention).

TABLE 1074

Amino acid mutations

| SNP position(s) on amino acid sequence | Alternative amino acid(s) | Previously known SNP? |
|---|---|---|
| 38 | V -> A | Yes |
| 104 | R -> P | Yes |
| 214 | A -> | No |
| 323 | Q -> H | Yes |

Variant protein HSSTROL3_P7 (SEQ ID NO:1396) is encoded by the following transcript(s): HSSTROL3_T10 (SEQ ID NO:128), for which the sequence(s) is/are given at the end of the application. The coding portion of transcript HSSTROL3_T10 (SEQ ID NO:128) is shown in bold; this coding portion starts at position 24 and ends at position 1133. The transcript also has the following SNPs as listed in Table 1075 (given according to their position on the nucleotide sequence, with the alternative nucleic acid listed; the last column indicates whether the SNP is known or not; the presence of known SNPs in variant protein HSSTROL3_P7 (SEQ ID NO:1396) sequence provides support for the deduced sequence of this variant protein according to the present invention).

TABLE 1075

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |

TABLE 1075-continued

Nucleic acid SNPs

| SNP position on nucleotide sequence | Alternative nucleic acid | Previously known SNP? |
| --- | --- | --- |
| 992 | G -> C | Yes |
| 1386 | A -> G | Yes |
| 1568 | A -> G | Yes |
| 2109 | A -> G | Yes |
| 2250 | C -> | No |
| 2302 | C -> A | Yes |
| 2328 | A -> T | Yes |
| 2545 | -> G | No |
| 2554 | -> G | No |
| 2568 | C -> | No |
| 2587 | -> A | No |
| 2613 | T -> C | No |
| 2671 | A -> | No |
| 2671 | A -> C | No |
| 2821 | A -> | No |
| 2821 | A -> C | No |
| 2851 | T -> C | Yes |
| 2998 | -> T | No |

Variant protein HSSTROL3_P8 (SEQ ID NO:1397) according to the present invention has an amino acid sequence as given at the end of the application; it is encoded by transcript(s) HSSTROL3_T11 (SEQ ID NO:129). An alignment is given to the known protein (Stromelysin-3 Precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison Report Between HSSTROL3_P8 (SEQ ID NO:1397) and MM11_HUMAN (SEQ ID NO:1455):

1. An isolated chimeric polypeptide encoding for HSSTROL3_P8 (SEQ ID NO:1397), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN (SEQ ID NO:1455), which also corresponds to amino acids 1-163 of HSSTROL3_P8 (SEQ ID NO:1397), a bridging amino acid H corresponding to amino acid 164 of HSSTROL3_P8 (SEQ ID NO:1397), a second amino acid sequence being at least 90% homologous to GDDLPFDGPGGILAHAFFPKTHREGDVH-FDYDETWTIGDDQGTDLLQVAAHEFGHVLG LQHT-TAAKALMSAFYTFRYPLSLSPD-DCRGVQHLYGQPWPTVTSRTPALGPQAGIDTN EIAPLE corresponding to amino acids 165-286 of MM11_HUMAN (SEQ ID NO:1455), which also corresponds to amino acids 165-286 of HSSTROL3_P8 (SEQ ID NO:1397), and a third amino acid sequence being at least 70%, optionally at least 80%, preferably at least 85%, more preferably at least 90% and most preferably at least 95% homologous to a polypeptide having the sequence VRP-CLPVPLLLCWPL (SEQ ID NO: 254) corresponding to amino acids 287-301 of HSSTROL3_P8 (SEQ ID NO:1397), wherein said first amino acid sequence, bridging amino acid, second amino acid sequence and third amino acid sequence are contiguous and in a sequential order.

2. An isolated polypeptide encoding for a tail of HSSTROL3_P8 (SEQ ID NO:1397), comprising a polypeptide being at least 70%, optionally at least about 80%, preferably at least about 85%, more preferably at least about 90% and most preferably at least about 95% homologous to the sequence VRPCLPVPLLLCWPL (SEQ ID NO: 254) in HSSTROL3_P8 (SEQ ID NO:1397).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P8 (SEQ ID NO:1397) also has the following non-silent SNPs (Single Nucleotide Polymorphisms) as listed in Table 1076, (given according to their position(s) on the amino acid sequence, with the alternative amino acid(s) listed; the last column indicates whether the SNP is known or not; the presence of known SNPs in variant protein HSSTROL3_P8 (SEQ ID NO:1397) sequence provides support for the deduced sequence of this variant protein according to the present invention).

TABLE 1076

Amino acid mutations

| SNP position(s) on amino acid sequence | Alternative amino acid(s) | Previously known SNP? |
| --- | --- | --- |
| 38 | V -> A | Yes |
| 104 | R -> P | Yes |
| 214 | A -> | No |

Variant protein HSSTROL3_P8 (SEQ ID NO:1397) is encoded by the following transcript(s): HSSTROL3_T11 (SEQ ID NO:129), for which the sequence(s) is/are given at the end of the application. The coding portion of transcript HSSTROL3_T11 (SEQ ID NO:129) is shown in bold; this coding portion starts at position 24 and ends at position 926. The transcript also has the following SNPs as listed in Table 1077 (given according to their position on the nucleotide sequence, with the alternative nucleic acid listed; the last column indicates whether the SNP is known or not; the presence of known SNPs in variant protein HSSTROL3_P8 (SEQ ID NO:1397) sequence provides support for the deduced sequence of this variant protein according to the present invention).

TABLE 1077

Nucleic acid SNPs

| SNP position on nucleotide sequence | Alternative nucleic acid | Previously known SNP? |
| --- | --- | --- |
| 136 | T -> C | Yes |
| 334 | G -> C | Yes |
| 663 | G -> | No |
| 699 | -> T | No |
| 935 | G -> A | Yes |
| 948 | G -> A | Yes |
| 1084 | G -> C | Yes |
| 1557 | C -> | No |
| 1609 | C -> A | Yes |
| 1635 | A -> T | Yes |

TABLE 1077-continued

Nucleic acid SNPs

| SNP position on nucleotide sequence | Alternative nucleic acid | Previously known SNP? |
|---|---|---|
| 1852 | -> G | No |
| 1861 | -> G | No |
| 1875 | C -> | No |
| 1894 | -> A | No |
| 1920 | T -> C | No |
| 1978 | A -> | No |
| 1978 | A -> C | No |
| 2128 | A -> | No |
| 2128 | A -> C | No |
| 2158 | T -> C | Yes |
| 2305 | -> T | No |

Variant protein HSSTROL3_P9 (SEQ ID NO:1398) according to the present invention has an amino acid sequence as given at the end of the application; it is encoded by transcript(s) HSSTROL3_T12 (SEQ ID NO:130). An alignment is given to the known protein (Stromelysin-3 Precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison Report Between HSSTROL3_P9 (SEQ ID NO:1398) and MM11_HUMAN (SEQ ID NO:1455):

1. An isolated chimeric polypeptide encoding for HSSTROL3_P9 (SEQ ID NO:1398), comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGLSARNRQK corresponding to amino acids 1-96 of MM11_HUMAN (SEQ ID NO:1455), which also corresponds to amino acids 1-96 of HSSTROL3_P9 (SEQ ID NO:1398), a second amino acid sequence being at least 90% homologous to RILRFP-WQLVQEQVRQTMAEALKVWSDVTPLT-FTEVHEGRADIMIDFARYW corresponding to amino acids 113-163 of MM11_HUMAN (SEQ ID NO:1455), which also corresponds to amino acids 97-147 of HSSTROL3_P9 (SEQ ID NO:1398), a bridging amino acid H corresponding to amino acid 148 of HSSTROL3_P9 (SEQ ID NO:1398), a third amino acid sequence being at least 90% homologous to GDDLPFDGPGGILAHAFFPKTHREGD-VHFDYDETWTIGDDQGTDLLQVAAHEFGHVLG LQHTTAAKALMSAFYTFRYPLSLSPD-DCRGVQHLYGQPWPTVTSRTPALGPQAGIDTN EIA-PLEPDAPPDACEASFDAVSTIRGEL-FFFKAGFVWRLRGGQLQPGYPALASRHWQGL PSPVDAAFEDAQGHIWFFQG corresponding to amino acids 165-359 of MM11_HUMAN (SEQ ID NO:1455), which also corresponds to amino acids 149-343 of HSSTROL3_P9 (SEQ ID NO:1398), and a fourth amino acid sequence being at least 70%, optionally at least 80%, preferably at least 85%, more preferably at least 90% and most preferably at least 95% homologous to a polypeptide having the sequence TTGVSTPAPGV (SEQ ID NO: 253) corresponding to amino acids 344-354 of HSSTROL3_P9 (SEQ ID NO:1398), wherein said first amino acid sequence, second amino acid sequence, bridging amino acid, third amino acid sequence and fourth amino acid sequence are contiguous and in a sequential order.

2. An isolated chimeric polypeptide encoding for an edge portion of HSSTROL3_P9 (SEQ ID NO:1398), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96−x to 96; and ending at any of amino acid numbers 97+((n−2)−x), in which x varies from 0 to n−2.

3. An isolated polypeptide encoding for a tail of HSSTROL3_P9 (SEQ ID NO:1398), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P9 (SEQ ID NO:1398).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P9 (SEQ ID NO:1398) also has the following non-silent SNPs (Single Nucleotide Polymorphisms) as listed in Table 1078, (given according to their position(s) on the amino acid sequence, with the alternative amino acid(s) listed; the last column indicates whether the SNP is known or not; the presence of known SNPs in variant protein HSSTROL3_P9 (SEQ ID NO:1398) sequence provides support for the deduced sequence of this variant protein according to the present invention).

TABLE 1078

Amino acid mutations

| SNP position(s) on amino acid sequence | Alternative amino acid(s) | Previously known SNP? |
|---|---|---|
| 38 | V -> A | Yes |
| 198 | A -> | No |
| 307 | Q -> H | Yes |

Variant protein HSSTROL3_P9 (SEQ ID NO:1398) is encoded by the following transcript(s): HSSTROL3_T12 (SEQ ID NO:130), for which the sequence(s) is/are given at the end of the application. The coding portion of transcript HSSTROL3_T12 (SEQ ID NO:130) is shown in bold; this coding portion starts at position 24 and ends at position 1085. The transcript also has the following SNPs as listed in Table 1079 (given according to their position on the nucleotide sequence, with the alternative nucleic acid listed; the last column indicates whether the SNP is known or not; the presence of known SNPs in variant protein HSSTROL3_P9 (SEQ ID NO:1398) sequence provides support for the deduced sequence of this variant protein according to the present invention).

TABLE 1079

Nucleic acid SNPs

| SNP position on nucleotide sequence | Alternative nucleic acid | Previously known SNP? |
|---|---|---|
| 136 | T -> C | Yes |
| 615 | G -> | No |
| 651 | -> T | No |
| 944 | G -> C | Yes |
| 1275 | C -> | No |
| 1327 | C -> A | Yes |
| 1353 | A -> T | Yes |
| 1570 | -> G | No |
| 1579 | -> G | No |
| 1593 | C -> | No |
| 1612 | -> A | No |
| 1638 | T -> C | No |
| 1696 | A -> | No |
| 1696 | A -> C | No |
| 1846 | A -> | No |
| 1846 | A -> C | No |
| 1876 | T -> C | Yes |
| 2023 | -> T | No |

As noted above, cluster HSSTROL3 features 16 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSSTROL3_node__6 (SEQ ID NO:887) according to the present invention is supported by 14 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1080 below describes the starting and ending position of this segment on each transcript.

TABLE 1080

Segment location on transcripts

| Transcript name | Segment starting position | Segment ending position |
|---|---|---|
| HSSTROL3_T5 (SEQ ID NO: 125) | 1 | 131 |
| HSSTROL3_T8 (SEQ ID NO: 126) | 1 | 131 |
| HSSTROL3_T9 (SEQ ID NO: 127) | 1 | 131 |
| HSSTROL3_T10 (SEQ ID NO: 128) | 1 | 131 |
| HSSTROL3_T11 (SEQ ID NO: 129) | 1 | 131 |
| HSSTROL3_T12 (SEQ ID NO: 130) | 1 | 131 |

Segment cluster HSSTROL3_node__10 (SEQ ID NO:888) according to the present invention is supported by 21 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1081 below describes the starting and ending position of this segment on each transcript.

TABLE 1081

Segment location on transcripts

| Transcript name | Segment starting position | Segment ending position |
|---|---|---|
| HSSTROL3_T5 (SEQ ID NO: 125) | 132 | 313 |
| HSSTROL3_T8 (SEQ ID NO: 126) | 132 | 313 |
| HSSTROL3_T9 (SEQ ID NO: 127) | 132 | 313 |
| HSSTROL3_T10 (SEQ ID NO: 128) | 132 | 313 |
| HSSTROL3_T11 (SEQ ID NO: 129) | 132 | 313 |
| HSSTROL3_T12 (SEQ ID NO: 130) | 132 | 313 |

Segment cluster HSSTROL3_node__13 (SEQ ID NO:889) according to the present invention is supported by 36 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1082 below describes the starting and ending position of this segment on each transcript.

TABLE 1082

Segment location on transcripts

| Transcript name | Segment starting position | Segment ending position |
|---|---|---|
| HSSTROL3_T5 (SEQ ID NO: 125) | 362 | 505 |
| HSSTROL3_T8 (SEQ ID NO: 126) | 362 | 505 |
| HSSTROL3_T9 (SEQ ID NO: 127) | 362 | 505 |
| HSSTROL3_T10 (SEQ ID NO: 128) | 362 | 505 |
| HSSTROL3_T11 (SEQ ID NO: 129) | 362 | 505 |
| HSSTROL3_T12 (SEQ ID NO: 130) | 314 | 457 |

Segment cluster HSSTROL3_node__15 (SEQ ID NO:890) according to the present invention is supported by 47 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1083 below describes the starting and ending position of this segment on each transcript.

TABLE 1083

Segment location on transcripts

| Transcript name | Segment starting position | Segment ending position |
|---|---|---|
| HSSTROL3_T5 (SEQ ID NO: 125) | 506 | 639 |
| HSSTROL3_T8 (SEQ ID NO: 126) | 506 | 639 |
| HSSTROL3_T9 (SEQ ID NO: 127) | 506 | 639 |
| HSSTROL3_T10 (SEQ ID NO: 128) | 506 | 639 |
| HSSTROL3_T11 (SEQ ID NO: 129) | 506 | 639 |
| HSSTROL3_T12 (SEQ ID NO: 130) | 458 | 591 |

Segment cluster HSSTROL3_node__19 (SEQ ID NO:891) according to the present invention is supported by 63 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12

(SEQ ID NO:130). Table 1084 below describes the starting and ending position of this segment on each transcript.

TABLE 1084

Segment location on transcripts

| Transcript name | Segment starting position | Segment ending position |
|---|---|---|
| HSSTROL3_T5 (SEQ ID NO: 125) | 699 | 881 |
| HSSTROL3_T8 (SEQ ID NO: 126) | 699 | 881 |
| HSSTROL3_T9 (SEQ ID NO: 127) | 699 | 881 |
| HSSTROL3_T10 (SEQ ID NO: 128) | 699 | 881 |
| HSSTROL3_T11 (SEQ ID NO: 129) | 699 | 881 |
| HSSTROL3_T12 (SEQ ID NO: 130) | 651 | 833 |

Segment cluster HSSTROL3_node__21 (SEQ ID NO:892) according to the present invention is supported by 61 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1085 below describes the starting and ending position of this segment on each transcript.

TABLE 1085

Segment location on transcripts

| Transcript name | Segment starting position | Segment ending position |
|---|---|---|
| HSSTROL3_T5 (SEQ ID NO: 125) | 882 | 1098 |
| HSSTROL3_T8 (SEQ ID NO: 126) | 882 | 1098 |
| HSSTROL3_T9 (SEQ ID NO: 127) | 882 | 1098 |
| HSSTROL3_T10 (SEQ ID NO: 128) | 882 | 1098 |
| HSSTROL3_T11 (SEQ ID NO: 129) | 974 | 1190 |
| HSSTROL3_T12 (SEQ ID NO: 130) | 834 | 1050 |

Segment cluster HSSTROL3_node__24 (SEQ ID NO:893) according to the present invention is supported by 7 libraries. The number of libraries was determined as previously described. This segment can be found in the following transcript(s): HSSTROL3_T8 (SEQ ID NO:126) and HSSTROL3_T9 (SEQ ID NO:127). Table 1086 below describes the starting and ending position of this segment on each transcript.

TABLE 1086

Segment location on transcripts

| Transcript name | Segment starting position | Segment ending position |
|---|---|---|
| HSSTROL3_T8 (SEQ ID NO: 126) | 1099 | 1236 |
| HSSTROL3_T9 (SEQ ID NO: 127) | 1099 | 1236 |

Segment cluster HSSTROL3_node__25 (SEQ ID NO:894) according to the present invention is supported by 13 libraries. The number of libraries was determined as previously described. This segment can be found in the following transcript(s): HSSTROL3_T8 (SEQ ID NO:126). Table 1087 below describes the starting and ending position of this segment on each transcript.

TABLE 1087

Segment location on transcripts

| Transcript name | Segment starting position | Segment ending position |
|---|---|---|
| HSSTROL3_T8 (SEQ ID NO: 126) | 1237 | 1536 |

Segment cluster HSSTROL3_node__26 (SEQ ID NO:895) according to the present invention is supported by 55 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127) and HSSTROL3_T11 (SEQ ID NO:129). Table 1088 below describes the starting and ending position of this segment on each transcript.

TABLE 1088

Segment location on transcripts

| Transcript name | Segment starting position | Segment ending position |
|---|---|---|
| HSSTROL3_T5 (SEQ ID NO: 125) | 1099 | 1240 |
| HSSTROL3_T8 (SEQ ID NO: 126) | 1537 | 1678 |
| HSSTROL3_T9 (SEQ ID NO: 127) | 1237 | 1378 |
| HSSTROL3_T11 (SEQ ID NO: 129) | 1191 | 1332 |

Segment cluster HSSTROL3_node__28 (SEQ ID NO:896) according to the present invention is supported by 10 libraries. The number of libraries was determined as previously described. This segment can be found in the following transcript(s): HSSTROL3_T5 (SEQ ID NO:125), HSSTROL3_T9 (SEQ ID NO:127) and HSSTROL3_T10 (SEQ ID NO:128). Table 1089 below describes the starting and ending position of this segment on each transcript.

TABLE 1089

Segment location on transcripts

| Transcript name | Segment starting position | Segment ending position |
|---|---|---|
| HSSTROL3_T5 (SEQ ID NO: 125) | 1357 | 2283 |
| HSSTROL3_T9 (SEQ ID NO: 127) | 1495 | 2421 |
| HSSTROL3_T10 (SEQ ID NO: 128) | 1215 | 2141 |

Segment cluster HSSTROL3_node__29 (SEQ ID NO:897) according to the present invention is supported by 109 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T111 (SEQ ID NO:129) and HSSTROL3_T12 (SEQ ID NO:130). Table 1090 below describes the starting and ending position of this segment on each transcript.

TABLE 1090

Segment location on transcripts

| Transcript name | Segment starting position | Segment ending position |
|---|---|---|
| HSSTROL3_T5 (SEQ ID NO: 125) | 2284 | 3194 |
| HSSTROL3_T8 (SEQ ID NO: 126) | 1795 | 2705 |
| HSSTROL3_T9 (SEQ ID NO: 127) | 2422 | 3332 |
| HSSTROL3_T10 (SEQ ID NO: 128) | 2142 | 3052 |
| HSSTROL3_T11 (SEQ ID NO: 129) | 1449 | 2359 |
| HSSTROL3_T12 (SEQ ID NO: 130) | 1167 | 2077 |

According to an optional embodiment of the present invention, short segments related to the above cluster are also provided. These segments are up to about 120 bp in length, and so are included in a separate description.

Segment cluster HSSTROL3_node__11 (SEQ ID NO:898) according to the present invention is supported by 25 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128) and HSSTROL3_T11 (SEQ ID NO:129). Table 1091 below describes the starting and ending position of this segment on each transcript.

TABLE 1091

Segment location on transcripts

| Transcript name | Segment starting position | Segment ending position |
|---|---|---|
| HSSTROL3_T5 (SEQ ID NO: 125) | 314 | 361 |
| HSSTROL3_T8 (SEQ ID NO: 126) | 314 | 361 |
| HSSTROL3_T9 (SEQ ID NO: 127) | 314 | 361 |
| HSSTROL3_T10 (SEQ ID NO: 128) | 314 | 361 |
| HSSTROL3_T11 (SEQ ID NO: 129) | 314 | 361 |

Segment cluster HSSTROL3_node__17 (SEQ ID NO:899) according to the present invention is supported by 45 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1092 below describes the starting and ending position of this segment on each transcript.

TABLE 1092

Segment location on transcripts

| Transcript name | Segment starting position | Segment ending position |
|---|---|---|
| HSSTROL3_T5 (SEQ ID NO: 125) | 640 | 680 |
| HSSTROL3_T8 (SEQ ID NO: 126) | 640 | 680 |
| HSSTROL3_T9 (SEQ ID NO: 127) | 640 | 680 |
| HSSTROL3_T10 (SEQ ID NO: 128) | 640 | 680 |
| HSSTROL3_T11 (SEQ ID NO: 129) | 640 | 680 |
| HSSTROL3_T12 (SEQ ID NO: 130) | 592 | 632 |

Segment cluster HSSTROL3_node__18 (SEQ ID NO:900) according to the present invention can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1093 below describes the starting and ending position of this segment on each transcript.

TABLE 1093

Segment location on transcripts

| Transcript name | Segment starting position | Segment ending position |
|---|---|---|
| HSSTROL3_T5 (SEQ ID NO: 125) | 681 | 698 |
| HSSTROL3_T8 (SEQ ID NO: 126) | 681 | 698 |
| HSSTROL3_T9 (SEQ ID NO: 127) | 681 | 698 |
| HSSTROL3_T10 (SEQ ID NO: 128) | 681 | 698 |
| HSSTROL3_T11 (SEQ ID NO: 129) | 681 | 698 |
| HSSTROL3_T12 (SEQ ID NO: 130) | 633 | 650 |

Segment cluster HSSTROL3_node__20 (SEQ ID NO:901) according to the present invention is supported by 1 libraries. The number of libraries was determined as previously described. This segment can be found in the following transcript(s): HSSTROL3_T11 (SEQ ID NO:129). Table 1094 below describes the starting and ending position of this segment on each transcript.

TABLE 1094

Segment location on transcripts

| Transcript name | Segment starting position | Segment ending position |
|---|---|---|
| HSSTROL3_T11 (SEQ ID NO: 129) | 882 | 973 |

Segment cluster HSSTROL3_node__27 (SEQ ID NO:902) according to the present invention is supported by 50 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1095 below describes the starting and ending position of this segment on each transcript.

TABLE 1095

Segment location on transcripts

| Transcript name | Segment starting position | Segment ending position |
|---|---|---|
| HSSTROL3_T5 (SEQ ID NO: 125) | 1241 | 1356 |
| HSSTROL3_T8 (SEQ ID NO: 126) | 1679 | 1794 |
| HSSTROL3_T9 (SEQ ID NO: 127) | 1379 | 1494 |
| HSSTROL3_T10 (SEQ ID NO: 128) | 1099 | 1214 |
| HSSTROL3_T11 (SEQ ID NO: 129) | 1333 | 1448 |
| HSSTROL3_T12 (SEQ ID NO: 130) | 1051 | 1166 |

Variant Protein Alignment to the Previously Known Protein:
Sequence name: MM11_HUMAN (SEQ ID NO:1455)
Sequence documentation:
Alignment of: HSSTROL3_P4 (SEQ ID NO:1394) x MM11_HUMAN (SEQ ID NO:1455) ..

Alignment segment 1/1:

| | | | |
|---|---|---|---|
| Quality: | 4444.00 | Escore: | 0 |
| Matching length: | 445 | Total length: | 445 |
| Matching Percent Similarity: | 99.78 | Matching Percent Identity: | 99.78 |
| Total Percent Similarity: | 99.78 | Total Percent Identity: | 99.78 |
| Gaps: | 0 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKREVL 100
    ||||||||||||||||||||||||||||||||||||||||||||||||||
 51 WHAALPSSPAPAPATQEAPRPASSLRPPRCGVPDPSDGLSARNRQKREVL 100

101 SGGRWEKTDLTYRILRFPWQLVQEQVRQTMAEALKVWSDVTPLTFTEVHE 150
    ||||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    |||||||||||||||||||||||| |||||||||||||||||||||||||
151 GRADIMIDFARYWHGDDLPFDPGGILLAHAFFPKTHREGDVHFDYDETWT 200

201 IGDDQGTDLLQVAAHEFGHVLGLQHTTAAKALMSAFYTFRYPLSLSPDDC 250
    ||||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLEPDAPPDACEASFDA 300
    ||||||||||||||||||||||||||||||||||||||||||||||||||
251 RGVQHLYGQPWPTVTSRTPALGPQAGIDTNEIAPLEPDAPPDACEASFDA 300

301 VSTIRGELFFFKAGFVWRLRGGQLQPGYPALASRHWQGLPSPVDAAFEDA 350
    ||||||||||||||||||||||||||||||||||||||||||||||||||
301 VSTIRGELFFFKAGFVWRLRGGQLQPGYPALASRHWQGLPSPVDAAFEDA 350

351 QGHIWFFQGAQYWVYDGEKPVLGPAPLTELGLVRFPVHAALVWGPEKNKI 400
    ||||||||||||||||||||||||||||||||||||||||||||||||||
351 QGHIWFFQGAQYWVYDGEKPVLGPAPLTELGLVRFPVHAALVWGPEKNKI 400

401 YFFRGRDYWRFHPSTRRVDSPVPRRATDWRGVPSEIDAAFQDADG      445
    |||||||||||||||||||||||||||||||||||||||||||||
401 YFFRGRDYWRFHPSTRRVDSPVPRRATDWRGVPSEIDAAFQDADG      445
```

Sequence name: MM11_HUMAN (SEQ ID NO:1455)

Sequence documentation:

Alignment of: HSSTROL3_P5 (SEQ ID NO:1395) x MM11_HUMAN (SEQ ID NO:1455) ..

Alignment segment 1/1:

| | | | |
|---|---|---|---|
| Quality: | 3566.00 | Escore: | 0 |
| Matching length: | 358 | Total length: | 358 |
| Matching Percent Similarity: | 99.72 | Matching Percent Identity: | 99.72 |
| Total Percent Similarity: | 99.72 | Total Percent Identity: | 99.72 |
| Gaps: | 0 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKREVL 100
    ||||||||||||||||||||||||||||||||||||||||||||||||||
 51 WHAALPSSPAPAPATQEAPRPASSLRPPRCGVPDPSDGLSARNRQKREVL 100
```

```
101 SGGRWEKTDLTYRILRFPWQLVQEQVRQTMAEALKVWSDVTPLTFTEVHE 150
    ||||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    |||||||||||||||||||||| ||||| |||||||||||||||||||||
151 GRADIMIDFARYWHGDDLPFDPGGILLAHAFFPKTHREGDVHFDYDETWT 200

201 IGDDQGTDLLQVAAHEFGHVLGLQHTTAAKALMSAFYTFRYPLSLSPDDC 250
    ||||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLEPDAPPDACEASFDA 300
    ||||||||||||||||||||||||||||||||||||||||||||||||||
251 RGVQHLYGQPWPTVTSRTPALGPQAGIDTNEIAPLEPDAPPDACEASFDA 300

301 VSTIRGELFFFKAGFVWRLRGGQLQPGYPALASRHWQGLPSPVDAAFEDA 350
    ||||||||||||||||||||||||| ||||||||||||||||||||||||
301 VSTIRGELFFFKAGFVWRLRGGQLQPGYPALASRHWQGLPSPVDAAFEDA 350

351 QGHIWFFQ                                          358
    ||||||||
351 QGHIWFFQ                                          358
```

Sequence name: MM11_HUMAN (SEQ ID NO:1455)
Sequence documentation:
Alignment of: HSSTROL3_P7 (SEQ ID NO:1396) x MM11_HUMAN (SEQ ID NO:1455) ..
Alignment segment 1/1:

| | | | |
|---|---|---|---|
| Quality: | 3575.00 | Escore: | 0 |
| Matching length: | 359 | Total length: | 359 |
| Matching Percent Similarity: | 99.72 | Matching Percent Identity: | 99.72 |
| Total Percent Similarity: | 99.72 | Total Percent Identity: | 99.72 |
| Gaps: | 0 | | |

Alignment:

```
  1 MAPAAWLRSAAARALLPPMLLLLQPPPLLARALPPDVHHLHAERRGPQP 50
    ||||||||||||||||||||||||||||||||||||||||||||||||||
  1 MAPAAWLRSAAARALLPPMLLLLQPPPLLARALPPDVHHLHAERRGPQP 50

51 WHAALPSSPAPAPATQEAPRPASSLRPPRCGVPDPSDGLSARNRQKREVL 100
    ||||||||||||||||||||||||||||||||||||||||||||||||||
 51 WHAALPSSPAPAPATQEAPRPASSLRPPRCGVPDPSDGLSARNRQKREVL 100

101 SGGRWEKTDLTYRILRFPWQLVQEQVRQTMAEALKVWSDVTPLTFTEVHE 150
    ||||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    |||||||||||||||||||||| ||||| |||||||||||||||||||||
151 GRADIMIDFARYWHGDDLPFDPGGILLAHAFFPKTHREGDVHFDYDETWT 200

201 IGDDQGTDLLQVAAHEFGHVLGLQHTTAAKALMSAFYTFRYPLSLSPDDC 250
    ||||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLEPDAPPDACEASFDA 300
    ||||||||||||||||||||||||||||||||||||||||||||||||||
251 RGVQHLYGQPWPTVTSRTPALGPQAGIDTNEIAPLEPDAPPDACEASFDA 300

301 VSTIRGELFFFKAGFVWRLRGGQLQPGYPALASRHWQGLPSPVDAAFEDA 350
    ||||||||||||||||||||||||||||||||||||||||||||||||||
301 VSTIRGELFFFKAGFVWRLRGGQLQPGYPALASRHWQGLPSPVDAAFEDA 350

351 QGHIWFFQG                                         359
    |||||||||
351 QGHIWFFQG                                         359
``` equence name: MM11_HUMAN (SEQ ID NO:1455)

Sequence documentation:

Alignment of: HSSTROL3_P8 (SEQ ID NO:1397) x MM11_HUMAN (SEQ ID NO:1455) ..

Alignment segment 1/1:

| | | | |
|---|---|---|---|
| Quality: | 2838.00 | Escore: | 0 |
| Matching length: | 286 | Total length: | 286 |
| Matching Percent Similarity: | 99.65 | Matching Percent Identity: | 99.65 |
| Total Percent Similarity: | 99.65 | Total Percent Identity: | 99.65 |
| Gaps: | 0 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKREVL 100
    ||||||||||||||||||||||||||||||||||||||||||||||||||
 51 WHAALPSSPAPAPATQEAPRPASSLRPPRCGVPDPSDGLSARNRQKREVL 100

101 SGGRWEKTDLTYRILRFPWQLVQEQVRQTMAEALKVWSDVTPLTFTEVHE 150
    ||||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    ||||||||||||||||||||| |||||| |||||||||||||||||||||
151 GRADIMIDFARYWHGDDLPFDPGGILLAHAFFPKTHREGDVHFDYDETWT 200

201 IGDDQGTDLLQVAAHEFGHVLGLQHTTAAKALMSAFYTFRYPLSLSPDDC 250
    ||||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLE              286
    |||||||||||||||||||||||||||||||||||
251 RGVQHLYGQPWPTVTSRTPALGPQAGIDTNEIAPLE              286
```

Sequence name: MM11_HUMAN (SEQ ID NO:1455)

Sequence documentation:

Alignment of: HSSTROL3_P9 (SEQ ID NO:1398) x MM11_HUMAN (SEQ ID NO:1455) ..

Alignment segment 1/1:

| | | | |
|---|---|---|---|
| Quality: | 3316.00 | Escore: | 0 |
| Matching length: | 343 | Total length: | 359 |
| Matching Percent Similarity: | 99.71 | Matching Percent Identity: | 99.71 |
| Total Percent Similarity: | 95.26 | Total Percent Identity: | 95.26 |
| Gaps: | 1 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKREVL  96
    ||||||||||||||||||||||||||||||||||||||||||||||||||
 51 WHAALPSSPAPAPATQEAPRPASSLRPPRCGVPDPSDGLSARNRQKREVL 100

97 SGGRWEKTDLTYRILRFPWQLVQEQVRQTMAEALKVWSDVTPLTFTEVHE 134
    ||||||||||||||||||||||||||||||||||||||||||||||||||
101 SGGRWEKTDLTYRILRFPWQLVQEQVRQTMAEALKVWSDVTPLTFTEVHE 150

135 GRADIMIDFARYWHGDDLPFDGPGGILAHAFFPKTHREGDVHFDYDETWT 184
    ||||||||||||||||||||| |||||| |||||||||||||||||||||
151 GRADIMIDFARYWHGDDLPFDPGGILLAHAFFPKTHREGDVHFDYDETWT 200
```

-continued

```
185 IGDDQGTDLLQVAAHEFGHVLGLQHTTAAKALMSAFYTFRYPLSLSPDDC 234
    ||||||||||||||||||||||||||||||||||||||||||||||||||
201 IGDDQGTDLLQVAAHEFGHVLGLQHTTAAKALMSAFYTFRYPLSLSPDDC 250

235 RGVQHLYGQPWPTVTSRTPALGPQAGIDTNEIAPLEPDAPPDACEASFDA 284
    ||||||||||||||||||||||||||||||||||||||||||||||||||
251 RGVQHLYGQPWPTVTSRTPALGPQAGIDTNEIAPLEPDAPPDACEASFDA 300

285 VSTIRGELFFFKAGFVWRLRGGQLQPGYPALASRHWQGLPSPVDAAFEDA 334
    ||||||||||||||||||||||||||||||||||||||||||||||||||
301 VSTIRGELFFFKAGFVWRLRGGQLQPGYPALASRHWQGLPSPVDAAFEDA 350

335 QGHIWFFQG                                         343
    |||||||||
351 QGHIWFFQG                                         359
```

Expression of Stromelysin-3 Precursor HSSTROL3 Transcripts which are Detectable by Amplicon as Depicted in Sequence Name HSSTROL3 seg24 (SEQ ID NO:1675) in Normal and Cancerous Lung Tissues Expression of Stromelysin-3 Precursor (EC 3.4.24.-) (Matrix metalloproteinase-11) (MMP-11) (ST3) (SL-3) transcripts detectable by or according to seg24, HSSTROL3 seg24 amplicon (SEQ ID NO: 1675) and HSSTROL3 seg24F (SEQ ID NO: 1673) and HSSTROL3 seg24R (SEQ ID NO:1674) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2 "Tissue samples in testing panel", above), to obtain a value of fold up-regulation for each sample relative to median of the normal PM samples.

Figure 39:
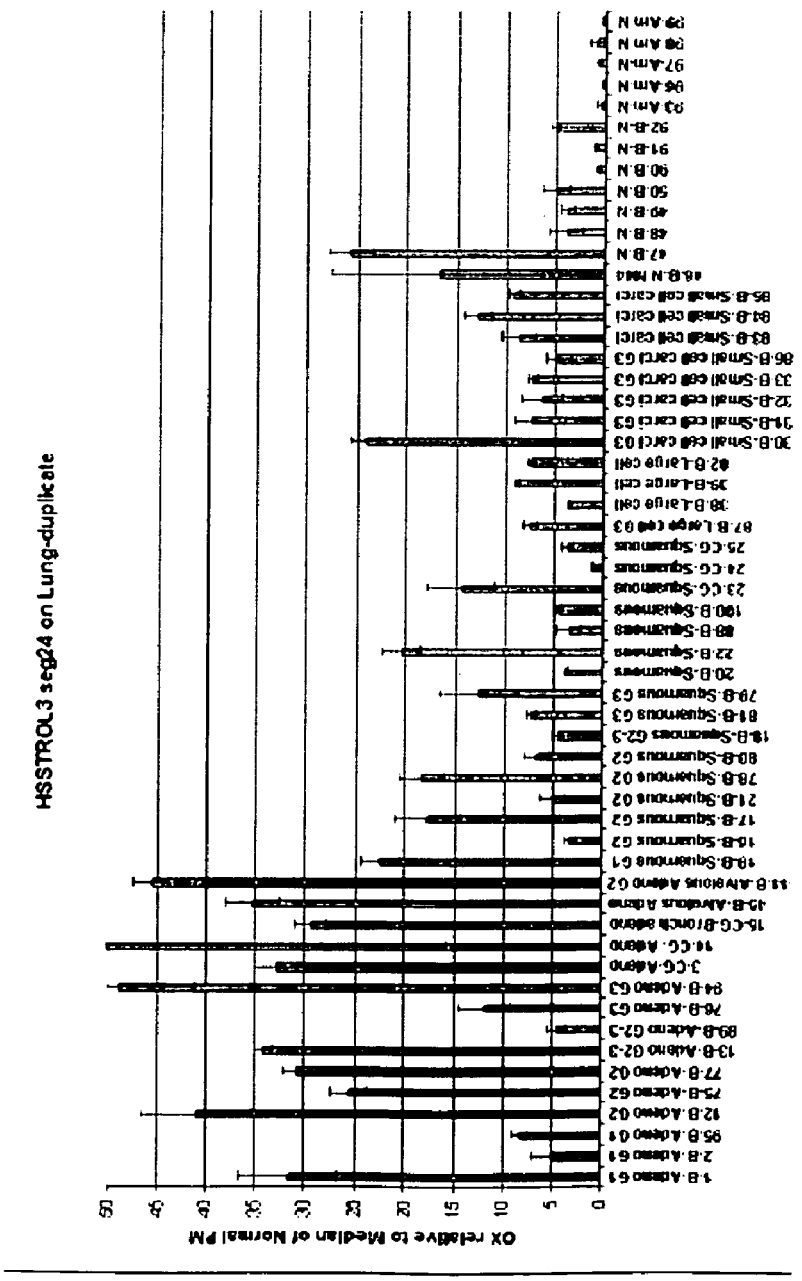
FIG. 39 is a histogram showing over expression of the Stromelysin-3 HSSTROL3 transcripts, which are detectable by amplicon as depicted in sequence name HSSTROL3 seg24 (SEQ ID NO: 1675), in cancerous lung samples relative to the normal samples.

FIG. 39 is a histogram showing over expression of the above-indicated Stromelysin-3 precursor transcripts in cancerous lung samples relative to the normal samples. Values represent the average of duplicate experiments. Error bars indicate the minimal and maximal values obtained.)

As is evident from FIG. 39, the expression of Stromelysin-3 Precursor transcripts detectable by the above amplicon(s) in cancer samples was significantly higher than in the non-cancerous samples (Sample Nos. 47-50, 90-93, 96-99 Table 2, "Tissue samples in testing panel"). Notably an over-expression of at least 5 fold was found in 13 out of 15 adenocarcinoma samples, 8 out of 16 squamous cell carcinoma samples, 3 out of 4 large cell carcinoma samples and in 7 out of 8 small cell carcinoma samples.

Threshold of 5 fold overexpression was found to differentiate between cancer and normal samples with P value of 4.04E-04 in adenocarcinoma, 9.89E-02 in squamous cell carcinoma, 6.04E-02 in Large cell carcinoma, 3.14E-03 in small cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSSTROL3 seg24F forward primer (SEQ ID NO: 1673); and HSSTROL3 seg24R reverse primer (SEQ ID NO: 1674).

The present invention also preferably encompasses any amplicon obtained through the use of any suitable primer pair; for example, for the above experiment, the following amplicon was obtained as a non-limiting illustrative example only of a suitable amplicon: HSSTROL3 seg24 (SEQ ID NO:1675).

```
Forward Primer:  (SEQ ID NO: 1673)
ATTTCCATCCTCAACTGGCAGA

Reverse Primer:  (SEQ ID NO: 1674)
TGCCCTGGAACCCACG

Amplicon:        (SEQ ID NO: 1675)
ATTTCCATCCTCAACTGGCAGAGATGAGAGCCTGGAGCATTGCAGATGCCAGGGAC

TTCACAAATGAAGGCACAGCATGGGAAACCTGCGTGGGTTCCAGGGCA
```

Expression of Stromelysin-3 Precursor HSSTROL3 Transcripts which are Detectable by Amplicon as Depicted in Sequence Name HSSTROL3 seg24 (SEQ ID NO:1675) in Different Normal Tissues Expression of Stromelysin-3 Precursor transcripts detectable by or according to HSSTROL3 seg24 amplicon (SEQ ID NO:1675) and HSSTROL3 seg24F (SEQ ID NO: 1673) and HSSTROL3 seg24R (SEQ ID NO: 1674) was measured by real time PCR. In parallel the expression of four housekeeping genes Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17, Table 2 "Tissue samples in normal panel", above), to obtain a value of relative expression of each sample relative to median of the lung samples.

```
Forward Primer:   (SEQ ID NO: 1673)
ATTTCCATCCTCAACTGGCAGA

Reverse Primer:   (SEQ ID NO: 1674)
TGCCCTGGAACCCACG

Amplicon:         (SEQ ID NO: 1675)
ATTTCCATCCTCAACTGGCAGAGATGAGAGCCTGGAGCATTGCAGATGCCAGGGAC

TTCACAAATGAAGGCACAGCATGGGAAACCTGCGTGGGTTCCAGGGCA
```

Figure 40:
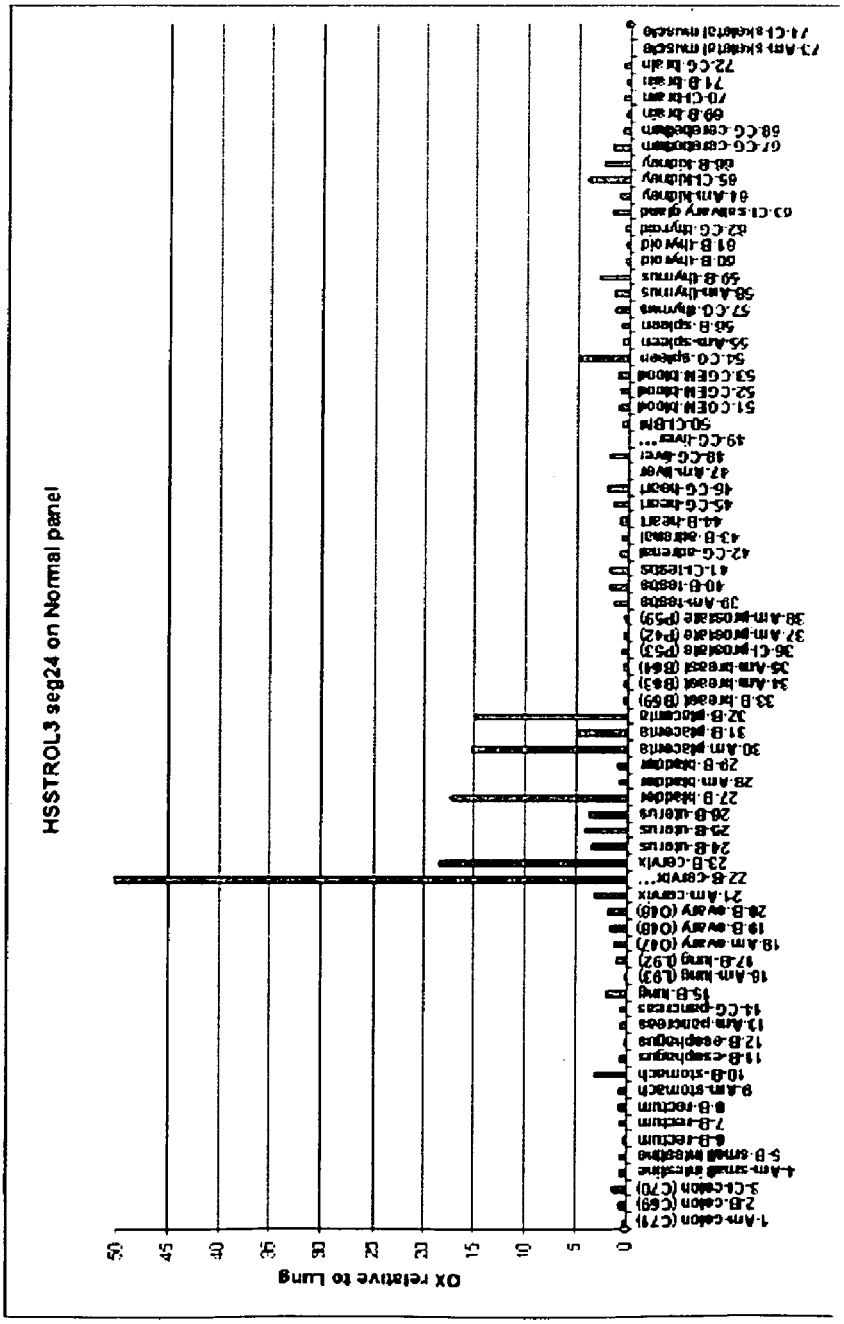
FIG. 40 is a histogram showing the expression of Stromelysin-3 HSSTROL3 transcripts, which are detectable by amplicon as depicted in sequence name HSSTROL3 seg24 (SEQ ID NO: 1675), in different normal tissues.

The results are demonstrated in FIG. 40, showing the expression of Stromelysin-3 HSSTROL3 transcripts, which are detectable by amplicon as depicted in sequence name HSSTROL3 seg24 (SEQ ID NO:1675), in different normal tissues.

Expression of *Homo sapiens* Matrix Metalloproteinase 11 (Stromelysin 3) (MMP11) HSSTROL3 Transcripts which are Detectable by Amplicon as Depicted in Sequence Name HSSTROL3 seg20-21 (SEQ ID NO:1678) in Normal and Cancerous Lung Tissues Expression of *Homo sapiens* matrix metalloproteinase 11 (stromelysin 3) (MMP11) transcripts detectable by or according to seg20-21, HSSTROL3 seg20-21 amplicon (SEQ ID NO: 1678) and primers HSSTROL3 seg20-21F (SEQ ID NO: 1676) and HSSTROL3 seg20-21R (SEQ ID NO: 1677) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 71:
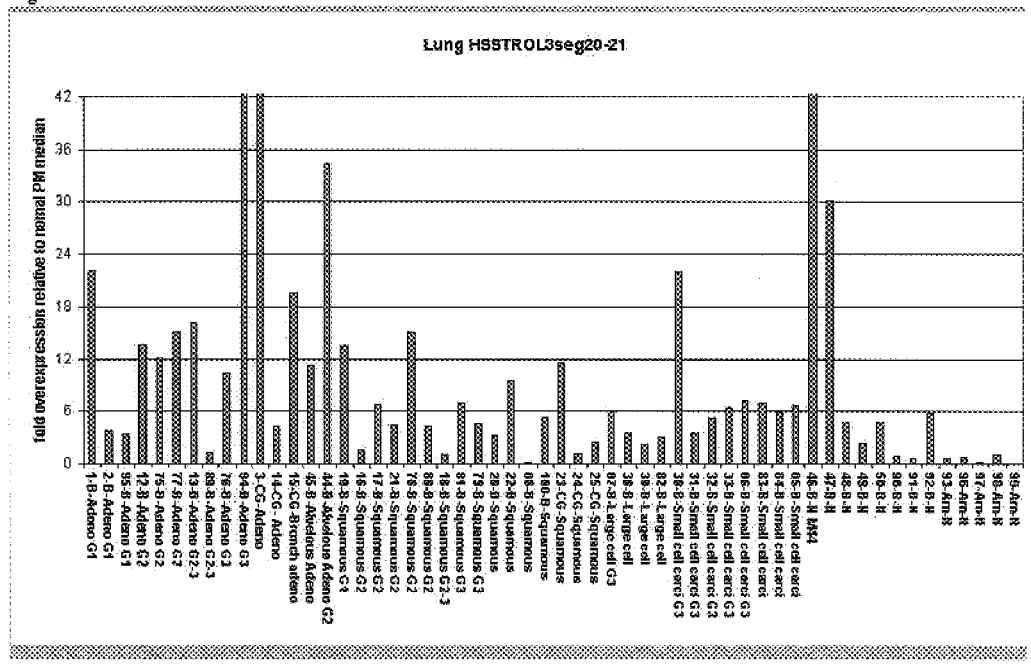
FIG. 71 is a histogram showing over expression of the *Homo sapiens* matrix metalloproteinase 11 (stromelysin 3) (MMP11) HSSTROL3 transcripts which are detectable by amplicon as depicted in sequence name HSSTROL3 seg20-2 (SEQ ID NO: 1678) in cancerous lung samples relative to the normal samples.

FIG. 71 is a histogram showing over expression of the above-indicated *Homo sapiens* matrix metalloproteinase 11 (stromelysin 3) (MMP11) transcripts in cancerous lung samples relative to the normal samples.

As is evident from FIG. 71, the expression of *Homo sapiens* matrix metalloproteinase 11 (stromelysin 3) (MMP11) transcripts detectable by the above amplicon(s) in cancer samples was significantly higher than in the non-cancerous samples (Sample Nos. 46-50, 90-93, 96-99 Table 2,). Notably an over-expression of at least 6 fold was found in 11 out of 15 adenocarcinoma samples, 6 out of 16 squamous cell carcinoma samples, 1 out of 4 large cell carcinoma samples and in 6 out of 8 small cells carcinoma samples.

Primer pairs are also optionally and preferably encompassed within the present invention; for example, for the above experiment, the following primer pair was used as a non-limiting illustrative example only of a suitable primer pair: HSSTROL3 seg20-21F forward primer (SEQ ID NO: 1676); and HSSTROL3 seg20-21R reverse primer (SEQ ID NO:1677).

The present invention also preferably encompasses any amplicon obtained through the use of any suitable primer pair; for example, for the above experiment, the following amplicon was obtained as a non-limiting illustrative example only of a suitable amplicon: HSSTROL3 seg20-21 (SEQ ID NO: 1678).

Primers:

```
Forward primer HSSTROL3 seg20-21F:  (SEQ ID NO: 1676)
TCTGCTGGCCACTGTGACTG

Reverse primer HSSTROL3 seg20-21R:  (SEQ ID NO: 1677)
GAAGAAAAAGAGCTCGCCTCG

Amplicon HSSTROL3 seg20-21:         (SEQ ID NO: 1678)
TCTGCTGGCCACTGTGACTGCAGCATATGCCCTCAGCATGTGTCCCTCTCTCCCACC

CCAGCCAGACGCCCGCCAGATGCCTGTGAGGCCTCCTTTGACGCGGTCTCCACCA

TCCGAGGCGAGCTCTTTTTCTTC
```

Expression of *Homo sapiens* Matrix Metalloproteinase 11 (Stromelysin 3) (MMP11) HSSTROL3 Transcripts which are Detectable by Amplicon as Depicted in Sequence Name HSSTROL3Junc21-27 (SEQ ID NO: 1681) in Normal and Cancerous Lung Tissues Expression of *Homo sapiens* matrix metalloproteinase 11 (stromelysin 3) (MMP11) transcripts detectable by or according to junc21-27, HSSTROL3 junc21-27 amplicon (SEQ ID NO: 1681) and primers HSSTROL3 junc21-27F (SEQ ID NO: 1679) and HSSTROL3 junc21-27R (SEQ ID NO: 1680) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 72:
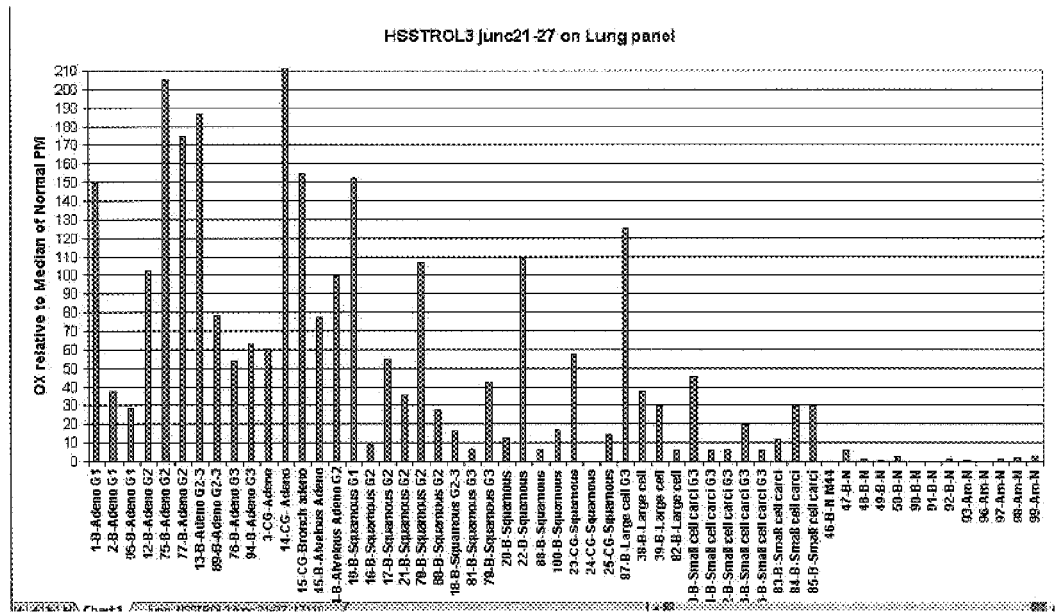
FIG. 72 is a histogram showing over expression of the *Homo sapiens* matrix metalloproteinase 11 (stromelysin 3) (MMP11) HSSTROL3 transcripts which are detectable by amplicon as depicted in sequence name HSSTROL3 junc21-27 (SEQ ID NO:1681) in cancerous lung samples relative to the normal samples.

FIG. 72 is a histogram showing over expression of the above-indicated *Homo sapiens* matrix metalloproteinase 11 (stromelysin 3) (MMP11) transcripts in cancerous lung samples relative to the normal samples.

As is evident from FIG. 72, the expression of *Homo sapiens* matrix metalloproteinase 11 (stromelysin 3) (MMP11) transcripts detectable by the above amplicon(s) in cancer samples was significantly higher than in the non-cancerous samples (Sample Nos. 46-50, 90-93, 96-99 Table 2,). Notably an over-expression of at least 10 fold was found in 15 out of 15 adenocarcinoma samples, 13 out of 16 squamous cell carcinoma samples, 3 out of 4 large cell carcinoma samples and in 5 out of 8 small cells carcinoma samples.

Primer pairs are also optionally and preferably encompassed within the present invention; for example, for the above experiment, the following primer pair was used as a non-limiting illustrative example only of a suitable primer pair: HSSTROL3 junc21-27F forward primer (SEQ ID NO: 1679); and HSSTROL3 junc21-27R reverse primer (SEQ ID NO: 1680).

The present invention also preferably encompasses any amplicon obtained through the use of any suitable primer pair; for example, for the above experiment, the following amplicon was obtained as a non-limiting illustrative example only of a suitable amplicon: HSSTROL3 junc21-27 (SEQ ID NO: 1681).

Primers:

```
Forward primer HSSTROL3 junc21-27F:   (SEQ ID NO: 1679)
ACATTTGGTTCTTCCAAGGGACTAC Reverse primer HSSTROL3 junc21-27R:   (SEQ ID NO: 1680)
TCGATCTCAGAGGGCACCC Amplicon HSSTROL3 junc21-27:          (SEQ ID NO: 1681)
ACATTTGGTTCTTCCAAGGGACTACTGGCGTTTCCACCCCAGCACCCGGCGTGTAGA

CAGTCCCGTGCCCCGCAGGGCCACTGACTGGAGAGGGGTGCCCTCTGAGATCGA
```

Description for Cluster HUMTREFAC

Cluster HUMTREFAC features 2 transcript(s) and 7 segment(s) of interest, the names for which are given in Tables 1096 and 1097, respectively, the sequences themselves are given at the end of the application. The selected protein variants are given in table 1098.

TABLE 1096

Transcripts of interest

| Transcript Name | Sequence ID No. |
|---|---|
| HUMTREFAC_PEA_2_T4 | 131 |
| HUMTREFAC_PEA_2_T5 | 132 |

TABLE 1097

Segments of interest

| Segment Name | Sequence ID No. |
|---|---|
| HUMTREFAC_PEA_2_node_0 | 903 |
| HUMTREFAC_PEA_2_node_9 | 904 |
| HUMTREFAC_PEA_2_node_2 | 905 |
| HUMTREFAC_PEA_2_node_3 | 906 |
| HUMTREFAC_PEA_2_node_4 | 907 |
| HUMTREFAC_PEA_2_node_5 | 908 |
| HUMTREFAC_PEA_2_node_8 | 909 |

TABLE 1098

Proteins of interest

| Protein Name | Sequence ID No. | Corresponding Transcript(s) |
|---|---|---|
| HUMTREFAC_PEA_2_P7 | 1399 | HUMTREFAC_PEA_2_T5 (SEQ ID NO: 132) |
| HUMTREFAC_PEA_2_P8 | 1400 | HUMTREFAC_PEA_2_T4 (SEQ ID NO: 131) |

These sequences are variants of the known protein Trefoil factor 3 Precursor (SwissProt accession identifier TFF3_HUMAN; known also according to the synonyms Intestinal trefoil factor; hP1.B), SEQ ID NO: 1456, referred to herein as the previously known protein.

Protein Trefoil factor 3 Precursor (SEQ ID NO:1456) is known or believed to have the following function(s): May have a role in promoting cell migration (motogen). The sequence for protein Trefoil factor 3 Precursor is given at the end of the application, as "Trefoil factor 3 precursor amino acid sequence". Known polymorphisms for this sequence are as shown in Table 1099.

TABLE 1099

Amino acid mutations for Known Protein

| SNP position(s) on amino acid sequence | Comment |
|---|---|
| 74-76 | QEA -> TRKT |

Protein Trefoil factor 3 Precursor (SEQ ID NO:1456) localization is believed to be Secreted.

The following GO Annotation(s) apply to the previously known protein. The following annotation(s) were found: defense response; digestion, which are annotation(s) related to Biological Process; and extracellular, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster HUMTREFAC can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 41 refer to weighted expression of ESTs in each category, as "parts per million" (ratio of the expression of ESTs for a particular cluster to the expression of all ESTs in that category, according to parts per million).

Figure 41:
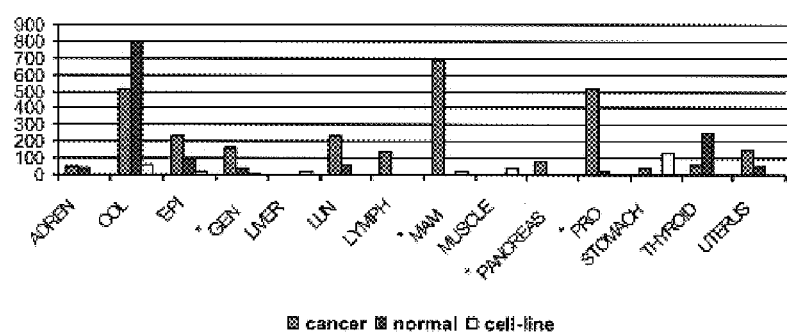
FIG. 41 is a histogram showing Cancer and cell-line vs. normal tissue expression for Cluster HUMTREFAC, demonstrating overexpression in a mixture of malignant tumors from different tissues, breast malignant tumors, pancreas carcinoma and prostate cancer.

Overall, the following results were obtained as shown with regard to the histograms in FIG. 41 and Table 1100. This cluster is overexpressed (at least at a minimum level) in the following pathological conditions: a mixture of malignant tumors from different tissues, breast malignant tumors, pancreas carcinoma and prostate cancer.

TABLE 1100

Normal tissue distribution

| Name of Tissue | Number |
|---|---|
| adrenal | 40 |
| colon | 797 |
| epithelial | 95 |
| general | 39 |
| liver | 0 |
| lung | 57 |
| lymph nodes | 3 |
| breast | 0 |
| muscle | 3 |
| pancreas | 2 |
| prostate | 16 |
| stomach | 0 |
| Thyroid | 257 |
| uterus | 54 |

TABLE 1101

P values and ratios for expression in cancerous tissue

| Name of Tissue | P1 | P2 | SP1 | R3 | SP2 | R4 |
|---|---|---|---|---|---|---|
| adrenal | 6.4e−01 | 6.9e−01 | 7.1e−01 | 1.1 | 7.8e−01 | 0.9 |
| colon | 4.6e−01 | 5.7e−01 | 9.7e−01 | 0.5 | 1 | 0.4 |
| epithelial | 2.4e−02 | 3.4e−01 | 9.5e−10 | 2.0 | 5.3e−02 | 1.1 |
| general | 2.5e−04 | 3.9e−02 | 1.4e−28 | 3.6 | 1.9e−10 | 1.9 |
| liver | 1 | 6.8e−01 | 1 | 1.0 | 6.9e−01 | 1.4 |
| lung | 4.8e−01 | 7.6e−01 | 2.2e−03 | 1.0 | 1.6e−01 | 0.5 |
| lymph nodes | 5.1e−01 | 8.0e−01 | 2.3e−02 | 5.0 | 1.9e−01 | 2.1 |
| breast | 7.6e−02 | 1.2e−01 | 3.1e−06 | 12.0 | 1.1e−03 | 6.5 |
| muscle | 9.2e−01 | 4.8e−01 | 1 | 0.8 | 3.9e−01 | 2.1 |
| pancreas | 1.2e−01 | 2.4e−01 | 5.7e−03 | 6.5 | 2.1e−02 | 4.6 |
| prostate | 1.5e−01 | 2.7e−01 | 9.9e−10 | 8.1 | 3.1e−07 | 5.7 |
| stomach | 3.0e−01 | 1.3e−01 | 5.0e−01 | 2.0 | 6.7e−02 | 2.8 |
| Thyroid | 6.4e−01 | 6.4e−01 | 9.6e−01 | 0.5 | 9.6e−01 | 0.5 |
| uterus | 4.1e−01 | 7.3e−01 | 7.5e−02 | 1.3 | 4.0e−01 | 0.8 |

As noted above, cluster HUMTREFAC features 2 transcript(s), which were listed in Table 1 above. These transcript(s) encode for protein(s) which are variant(s) of protein Trefoil factor 3 precursor (SEQ ID NO:1456). A description of each variant protein according to the present invention is now provided.

Variant protein HUMTREFAC_PEA_2_P7 (SEQ ID NO:1399) according to the present invention has an amino acid sequence as given at the end of the application; it is encoded by transcript(s) HUMTREFAC_PEA_2_T5 (SEQ ID NO:132). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA_2_P7 (SEQ ID NO:1399) also has the following non-silent SNPs (Single Nucleotide Polymorphisms) as listed in Table 1102, (given according to their position(s) on the amino acid sequence, with the alternative amino acid(s) listed; the last column indicates whether the SNP is known or not; the presence of known SNPs in variant protein HUMTREFAC_PEA_2_P7 (SEQ ID NO:1399) sequence provides support for the deduced sequence of this variant protein according to the present invention).

TABLE 1102

Amino acid mutations

| SNP position(s) on amino acid sequence | Alternative amino acid(s) | Previously known SNP? |
|---|---|---|
| 5 | A -> S | No |
| 5 | A -> T | No |
| 14 | A -> V | Yes |
| 43 | L -> M | No |
| 60 | P -> S | Yes |
| 123 | S -> * | Yes |

Variant protein HUMTREFAC_PEA_2_P7 (SEQ ID NO:1399) is encoded by the following transcript(s): HUMTREFAC_PEA_2_T5 (SEQ ID NO:132), for which the sequence(s) is/are given at the end of the application. The coding portion of transcript HUMTREFAC_PEA_2_T5 (SEQ ID NO:132) is shown in bold; this coding portion starts at position 278 and ends at position 688. The transcript also has the following SNPs as listed in Table 1103 (given according to their position on the nucleotide sequence, with the alternative nucleic acid listed; the last column indicates whether the SNP is known or not; the presence of known SNPs in variant protein HUMTREFAC_PEA_2_P7 (SEQ ID NO:1399) sequence provides support for the deduced sequence of this variant protein according to the present invention).

TABLE 1103

Nucleic acid SNPs

| SNP position on nucleotide sequence | Alternative nucleic acid | Previously known SNP? |
|---|---|---|
| 233 | A -> G | Yes |
| 290 | G -> A | No |
| 290 | G -> T | No |
| 318 | C -> T | Yes |

TABLE 1103-continued

Nucleic acid SNPs

| SNP position on nucleotide sequence | Alternative nucleic acid | Previously known SNP? |
|---|---|---|
| 404 | C -> A | No |
| 404 | C -> T | No |
| 455 | C -> T | Yes |
| 645 | C -> A | Yes |
| 685 | C -> T | No |

Variant protein HUMTREFAC_PEA_2_P8 (SEQ ID NO:1400) according to the present invention has an amino acid sequence as given at the end of the application; it is encoded by transcript(s) HUMTREFAC_PEA_2_T4 (SEQ ID NO:131). An alignment is given to the known protein (Trefoil factor 3 Precursor (SEQ ID NO:1456)) at the end of the application. One or more alignments to one or more previously published protein sequences are given at the end of the application. A brief description of the relationship of the variant protein according to the present invention to each such aligned protein is as follows:

Comparison Report Between HUMTREFAC_PEA_2_P8 (SEQ ID NO:1400) and TFF3_HUMAN (SEQ ID NO:1456):

1. An isolated chimeric polypeptide encoding for HUMTREFAC_PEA_2_P8 (SEQ ID NO:1400), comprising a first amino acid sequence being at least 90% homologous to MAARALCMLGLVLALLSSSSAEEYVGL corresponding to amino acids 1-27 of TFF3_HUMAN (SEQ ID NO:1456), which also corresponds to amino acids 1-27 of HUMTRE-FAC_PEA_2_P8 (SEQ ID NO:1400), and a second amino acid sequence being at least 70%, optionally at least 80%, preferably at least 85%, more preferably at least 90% and most preferably at least 95% homologous to a polypeptide having the sequence WKVHLPKGEGFSSG (SEQ ID NO:1774) corresponding to amino acids 28-41 of HUMTRE-FAC_PEA_2_P8 (SEQ ID NO:1400), wherein said first amino acid sequence and second amino acid sequence are contiguous and in a sequential order.

2. An isolated polypeptide encoding for a tail of HUMTREFAC_PEA_2_P8 (SEQ ID NO:1400), comprising a polypeptide being at least 70%, optionally at least about 80%, preferably at least about 85%, more preferably at least about 90% and most preferably at least about 95% homologous to the sequence WKVHLPKGEGFSSG (SEQ ID NO:1774) in HUMTREFAC_PEA_2_P8 (SEQ ID NO:1400).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA_2_P8 (SEQ ID NO:1400) also has the following non-silent SNPs (Single Nucleotide Polymorphisms) as listed in Table 1104, (given according to their position(s) on the amino acid sequence, with the alternative amino acid(s) listed; the last column indicates whether the SNP is known or not; the presence of known SNPs in variant protein HUMTREFAC_PEA_2_P8 (SEQ ID NO:1400) sequence provides support for the deduced sequence of this variant protein according to the present invention).

TABLE 1104

Amino acid mutations

| SNP position(s) on amino acid sequence | Alternative amino acid(s) | Previously known SNP? |
|---|---|---|
| 5 | A -> S | No |
| 5 | A -> T | No |
| 14 | A -> V | Yes |

Variant protein HUMTREFAC_PEA_2_P8 (SEQ ID NO:1400) is encoded by the following transcript(s): HUMTREFAC_PEA_2_T4 (SEQ ID NO:131), for which the sequence(s) is/are given at the end of the application. The coding portion of transcript HUMTREFAC_PEA_2_T4 (SEQ ID NO:131) is shown in bold; this coding portion starts at position 278 and ends at position 400. The transcript also has the following SNPs as listed in Table 1105 (given according to their position on the nucleotide sequence, with the alternative nucleic acid listed; the last column indicates whether the SNP is known or not; the presence of known SNPs in variant protein HUMTREFAC_PEA_2_P8 (SEQ ID NO:1400) sequence provides support for the deduced sequence of this variant protein according to the present invention).

TABLE 1105

Nucleic acid SNPs

| SNP position on nucleotide sequence | Alternative nucleic acid | Previously known SNP? |
|---|---|---|
| 233 | A -> G | Yes |
| 290 | G -> A | No |
| 290 | G -> T | No |
| 318 | C -> T | Yes |
| 515 | C -> A | No |
| 515 | C -> T | No |
| 566 | C -> T | Yes |
| 756 | C -> A | Yes |
| 796 | C -> T | No |
| 1265 | A -> C | No |
| 1266 | A -> T | No |

As noted above, cluster HUMTREFAC features 7 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMTREFAC_PEA_2_node_0 (SEQ ID NO:903) according to the present invention is supported by 188 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1106 below describes the starting and ending position of this segment on each transcript.

TABLE 1106

Segment location on transcripts

| Transcript name | Segment starting position | Segment ending position |
|---|---|---|
| HUMTREFAC_PEA_2_T4 (SEQ ID NO: 131) | 1 | 359 |
| HUMTREFAC_PEA_2_T5 (SEQ ID NO: 132) | 1 | 359 |

Segment cluster HUMTREFAC_PEA_2_node_9 (SEQ ID NO:904) according to the present invention is supported by 150 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1107 below describes the starting and ending position of this segment on each transcript.

TABLE 1107

Segment location on transcripts

| Transcript name | Segment starting position | Segment ending position |
|---|---|---|
| HUMTREFAC_PEA_2_T4 (SEQ ID NO: 131) | 681 | 1266 |
| HUMTREFAC_PEA_2_T5 (SEQ ID NO: 132) | 570 | 747 |

According to an optional embodiment of the present invention, short segments related to the above cluster are also provided. These segments are up to about 120 bp in length, and so are included in a separate description.

Segment cluster HUMTREFAC_PEA_2_node_2 (SEQ ID NO:905) according to the present invention is supported by 4 libraries. The number of libraries was determined as previously described. This segment can be found in the following transcript(s): HUMTREFAC_PEA_2_T4 (SEQ ID NO:131). Table 1108 below describes the starting and ending position of this segment on each transcript.

TABLE 1108

Segment location on transcripts

| Transcript name | Segment starting position | Segment ending position |
|---|---|---|
| HUMTREFAC_PEA_2_T4 (SEQ ID NO: 131) | 360 | 470 |

Segment cluster HUMTREFAC_PEA_2_node_3 (SEQ ID NO:906) according to the present invention is supported by 10 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1109 below describes the starting and ending position of this segment on each transcript.

TABLE 1109

Segment location on transcripts

| Transcript name | Segment starting position | Segment ending position |
|---|---|---|
| HUMTREFAC_PEA_2_T4 (SEQ ID NO: 131) | 471 | 514 |
| HUMTREFAC_PEA_2_T5 (SEQ ID NO: 132) | 360 | 403 |

Segment cluster HUMTREFAC_PEA_2_node_4 (SEQ ID NO:907) according to the present invention is supported by 197 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1110 below describes the starting and ending position of this segment on each transcript.

TABLE 1110

Segment location on transcripts

| Transcript name | Segment starting position | Segment ending position |
|---|---|---|
| HUMTREFAC_PEA_2_T4 (SEQ ID NO: 131) | 515 | 611 |
| HUMTREFAC_PEA_2_T5 (SEQ ID NO: 132) | 404 | 500 |

Segment cluster HUMTREFAC_PEA_2_node_5 (SEQ ID NO:908) according to the present invention is supported by 187 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1111 below describes the starting and ending position of this segment on each transcript.

TABLE 1111

Segment location on transcripts

| Transcript name | Segment starting position | Segment ending position |
|---|---|---|
| HUMTREFAC_PEA_2_T4 (SEQ ID NO: 131) | 612 | 661 |
| HUMTREFAC_PEA_2_T5 (SEQ ID NO: 132) | 501 | 550 |

Segment cluster HUMTREFAC_PEA_2_node_8 (SEQ ID NO:909) according to the present invention can be found in the following transcript(s): HUMTREFAC_PEA_2_T4 (SEQ ID NO:131) and HUMTREFAC_PEA_2_T5 (SEQ ID NO:132). Table 1112 below describes the starting and ending position of this segment on each transcript.

TABLE 1112

Segment location on transcripts

| Transcript name | Segment starting position | Segment ending position |
|---|---|---|
| HUMTREFAC_PEA_2_T4 (SEQ ID NO: 131) | 662 | 680 |

TABLE 1112-continued

Segment location on transcripts

| Transcript name | Segment starting position | Segment ending position |
|---|---|---|
| HUMTREFAC_PEA_2_T5 (SEQ ID NO: 132) | 551 | 569 |

Variant Protein Alignment to the Previously Known Protein:
Sequence name: TFF3_HUMAN (SEQ ID NO:1456)
Sequence documentation:
Alignment of: HUMTREFAC_PEA_2_P8 (SEQ ID NO:1400) x TFF3_HUMAN (SEQ ID NO:1456) ..
Alignment segment 1/1:

| | | | |
|---|---|---|---|
| Quality: | 246.00 | Escore: | 0 |
| Matching length: | 27 | Total length: | 27 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MAAARALCMLGLVLALLSSSSAEEYVGL 27
    |||||||||||||||||||||||||||
  1 MAAARALCMLGLVLALLSSSSAEEYVGL 27
```

Description for Cluster HSS100PCB

Cluster HSS100PCB features 1 transcript(s) and 3 segment(s) of interest, the names for which are given in Tables 1113 and 1114, respectively, the sequences themselves are given at the end of the application. The selected protein variants are given in table 1115.

TABLE 1113

Transcripts of interest

| Transcript Name | Sequence ID No. |
|---|---|
| HSS100PCB_T1 | 133 |

TABLE 1114

Segments of interest

| Segment Name | Sequence ID No. |
|---|---|
| HSS100PCB_node_3 | 910 |
| HSS100PCB_node_4 | 911 |
| HSS100PCB_node_5 | 912 |

TABLE 1115

Proteins of interest

| Protein Name | Sequence ID No. | Corresponding Transcript(s) |
|---|---|---|
| HSS100PCB_P3 | 1401 | HSS100PCB_T1 (SEQ ID NO: 133) |

These sequences are variants of the known protein S-100P protein (SwissProt accession identifier S10P_HUMAN), SEQ ID NO:1457, referred to herein as the previously known protein, which binds two calcium ions.

The sequence for protein S-100P protein (SEQ ID NO:1457) is given at the end of the application, as "S-100P protein amino acid sequence". Known polymorphisms for this sequence are as shown in Table 1116.

TABLE 1116

Amino acid mutations for Known Protein

| SNP position(s) on amino acid sequence | Comment |
|---|---|
| 32 | E -> T |
| 44 | F -> E |

The following GO Annotation(s) apply to the previously known protein. The following annotation(s) were found: calcium binding; protein binding, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster HSS100PCB can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 42 refer to weighted expression of ESTs in each category, as "parts per million" (ratio of the expression of ESTs for a particular cluster to the expression of all ESTs in that category, according to parts per million).

Figure 42:
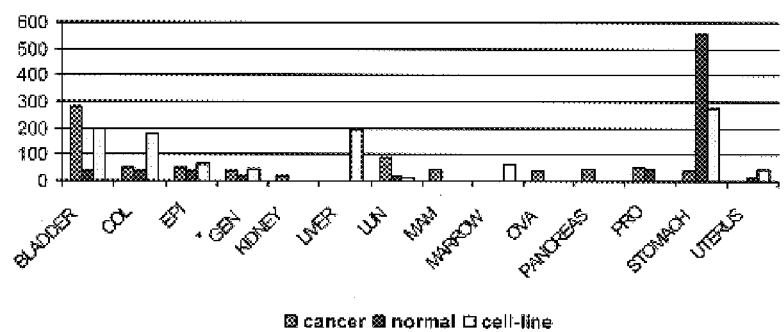
FIG. 42 is a histogram showing Cancer and cell-line vs. normal tissue expression for Cluster HSS100PCB, demonstrating overexpression in a mixture of malignant tumors from different tissues.

Overall, the following results were obtained as shown with regard to the histograms in FIG. 42 and Table 1117. This cluster is overexpressed (at least at a minimum level) in the following pathological conditions: a mixture of malignant tumors from different tissues.

TABLE 1117

Normal tissue distribution

| Name of Tissue | Number |
|---|---|
| bladder | 41 |
| colon | 37 |
| epithelial | 38 |
| general | 22 |
| kidney | 0 |
| liver | 0 |
| lung | 18 |
| breast | 0 |
| bone marrow | 0 |
| ovary | 0 |
| pancreas | 0 |
| prostate | 46 |

TABLE 1117-continued

Normal tissue distribution

| Name of Tissue | Number |
|---|---|
| stomach | 553 |
| uterus | 13 |

TABLE 1118

P values and ratios for expression in cancerous tissue

| Name of Tissue | P1 | P2 | SP1 | R3 | SP2 | R4 |
|---|---|---|---|---|---|---|
| bladder | 3.3e−01 | 2.9e−01 | 2.9e−02 | 2.8 | 3.5e−02 | 2.8 |
| colon | 3.0e−01 | 1.9e−01 | 5.2e−01 | 1.2 | 2.4e−01 | 1.7 |
| epithelial | 4.7e−02 | 1.6e−02 | 2.0e−01 | 1.2 | 6.1e−02 | 1.3 |
| general | 1.1e−03 | 6.8e−05 | 1.4e−02 | 1.5 | 4.9e−04 | 1.7 |
| kidney | 6.5e−01 | 7.2e−01 | 5.8e−01 | 1.7 | 7.0e−01 | 1.4 |
| liver | 9.1e−01 | 4.9e−01 | 1 | 1.0 | 7.7e−02 | 2.1 |
| lung | 6.8e−01 | 7.3e−01 | 2.2e−01 | 2.9 | 1.3e−01 | 1.7 |
| breast | 2.8e−01 | 3.2e−01 | 4.7e−01 | 2.0 | 6.8e−01 | 1.5 |
| bone marrow | 1 | 6.7e−01 | 1 | 1.0 | 2.8e−01 | 2.8 |
| ovary | 2.6e−01 | 3.0e−01 | 4.7e−01 | 2.0 | 5.9e−01 | 1.7 |
| pancreas | 3.3e−01 | 4.4e−01 | 7.6e−02 | 3.7 | 1.5e−01 | 2.8 |
| prostate | 9.1e−01 | 9.3e−01 | 5.8e−01 | 0.6 | 7.6e−01 | 0.5 |
| stomach | 3.7e−01 | 3.2e−01 | 1 | 0.1 | 1 | 0.3 |
| uterus | 9.4e−01 | 7.0e−01 | 1 | 0.6 | 4.1e−01 | 1.1 |

As noted above, cluster HSS100PCB features 1 transcript(s), which were listed in Table 1 above. These transcript(s) encode for protein(s) which are variant(s) of protein S-100P protein (SEQ ID NO:1457). A description of each variant protein according to the present invention is now provided.

Variant protein HSS100PCB_P3 (SEQ ID NO:1401) according to the present invention has an amino acid sequence as given at the end of the application; it is encoded by transcript(s) HSS100PCB_T1 (SEQ ID NO:133). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSS100PCB_P3 (SEQ ID NO:1401) also has the following non-silent SNPs (Single Nucleotide Polymorphisms) as listed in Table 1119, (given according to their position(s) on the amino acid sequence, with the alternative amino acid(s) listed; the last column indicates whether the SNP is known or not; the presence of known SNPs in variant protein HSS100PCB_P3 (SEQ ID NO:1401) sequence provides support for the deduced sequence of this variant protein according to the present invention).

TABLE 1119

Amino acid mutations

| SNP position(s) on amino acid sequence | Alternative amino acid(s) | Previously known SNP? |
|---|---|---|
| 1 | M -> R | Yes |
| 11 | M -> L | Yes |
| 20 | L -> F | Yes |

Variant protein HSS100PCB_P3 (SEQ ID NO:1401) is encoded by the following transcript(s): HSS100PCB_T1 (SEQ ID NO:133), for which the sequence(s) is/are given at the end of the application. The coding portion of transcript HSS100PCB_T1 (SEQ ID NO:133) is shown in bold; this coding portion starts at position 1057 and ends at position 1533. The transcript also has the following SNPs as listed in Table 1120 (given according to their position on the nucleotide sequence, with the alternative nucleic acid listed; the last column indicates whether the SNP is known or not; the presence of known SNPs in variant protein HSS100PCB_P3 (SEQ ID NO:1401) sequence provides support for the deduced sequence of this variant protein according to the present invention).

TABLE 1120

Nucleic acid SNPs

| SNP position on nucleotide sequence | Alternative nucleic acid | Previously known SNP? |
|---|---|---|
| 52 | C -> T | Yes |
| 107 | A -> C | Yes |
| 458 | C -> T | Yes |
| 468 | A -> G | Yes |
| 648 | C -> T | Yes |
| 846 | C -> G | Yes |
| 882 | G -> A | Yes |
| 960 | C -> T | No |
| 965 | C -> T | Yes |
| 1058 | T -> G | Yes |
| 1087 | A -> C | Yes |
| 1114 | C -> T | Yes |
| 1968 | G -> A | Yes |
| 1971 | C -> T | Yes |
| 2010 | C -> A | Yes |
| 2099 | G -> | No |

As noted above, cluster HSS100PCB features 3 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSS100PCB_node_3 (SEQ ID NO:910) according to the present invention is supported by 16 libraries. The number of libraries was determined as previously described. This segment can be found in the following transcript(s): HSS100PCB_T1 (SEQ ID NO:133). Table 1121 below describes the starting and ending position of this segment on each transcript.

TABLE 1121

Segment location on transcripts

| Transcript name | Segment starting position | Segment ending position |
|---|---|---|
| HSS100PCB_T1 (SEQ ID NO: 133) | 1 | 1133 |

Segment cluster HSS100PCB_node_4 (SEQ ID NO:911) according to the present invention is supported by 29 libraries. The number of libraries was determined as previously described. This segment can be found in the following transcript(s): HSS100PCB_T1 (SEQ ID NO:133). Table 1122 below describes the starting and ending position of this segment on each transcript.

TABLE 1123

Segment location on transcripts

| Transcript name | Segment starting position | Segment ending position |
|---|---|---|
| HSS100PCB_T1 (SEQ ID NO: 133) | 1134 | 1923 |

Segment cluster HSS100PCB_node_5 (SEQ ID NO:912) according to the present invention is supported by 141 libraries. The number of libraries was determined as previously described. This segment can be found in the following transcript(s): HSS100PCB_T1 (SEQ ID NO:133). Table 1124 below describes the starting and ending position of this segment on each transcript.

TABLE 1124

Segment location on transcripts

| Transcript name | Segment starting position | Segment ending position |
|---|---|---|
| HSS100PCB_T1 (SEQ ID NO: 133) | 1924 | 2201 |

Description for Cluster HSU33147

Cluster HSU33147 features 2 transcript(s) and 5 segment(s) of interest, the names for which are given in Tables 1125 and 1126, respectively, the sequences themselves are given at the end of the application. The selected protein variants are given in table 1127.

TABLE 1125

Transcripts of interest

| Transcript Name | Sequence ID No. |
|---|---|
| HSU33147_PEA_1_T1 | 1464 |
| HSU33147_PEA_1_T2 | 1465 |

TABLE 1126

Segments of interest

| Segment Name | Sequence ID No. |
|---|---|
| HSU33147_PEA_1_node_0 | 1276 |
| HSU33147_PEA_1_node_2 | 1277 |
| HSU33147_PEA_1_node_4 | 1278 |
| HSU33147_PEA_1_node_7 | 1279 |
| HSU33147_PEA_1_node_3 | 1280 |

TABLE 1127

Proteins of interest

| Protein Name | Sequence ID No. | Corresponding Transcript(s) |
|---|---|---|
| HSU33147_PEA_1_P5 | 1415 | HSU33147_PEA_1_T1 (SEQ ID NO: 1464); HSU33147_PEA_1_T2 (SEQ ID NO: 1465) |

These sequences are variants of the known protein Mammaglobin A precursor (SwissProt accession identifier MGBA_HUMAN; known also according to the synonyms Mammaglobin 1; Secretoglobin family 2A member 2), SEQ ID NO: 1416, referred to herein as the previously known protein.

The sequence for protein Mammaglobin A precursor (SEQ ID NO:1416) is given at the end of the application, as "Mammaglobin A precursor amino acid sequence".

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: steroid binding, which are annotation(s) related to Molecular Function.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster HSU33147 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 43 refer to weighted expression of ESTs in each category, as "parts per million" (ratio of the expression of ESTs for a particular cluster to the expression of all ESTs in that category, according to parts per million).

Figure 43:
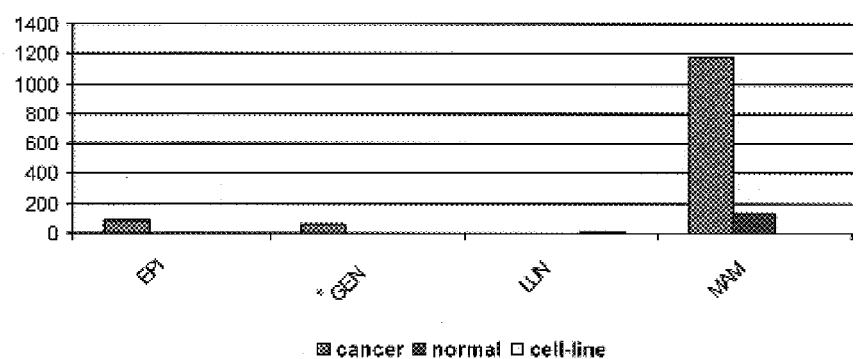
FIG. 43 is a histogram showing Cancer and cell-line vs. normal tissue expression for Cluster HSU33147, demonstrating overexpression in a mixture of malignant tumors from different tissues.

Overall, the following results were obtained as shown with regard to the histograms in FIG. 43 and Table 1128. This cluster is overexpressed (at least at a minimum level) in the following pathological conditions: a mixture of malignant tumors from different tissues.

TABLE 1128

Normal tissue distribution

| Name of Tissue | Number |
|---|---|
| epithelial | 6 |
| general | 2 |
| lung | 0 |
| breast | 131 |

TABLE 1129

P values and ratios for expression in cancerous tissue

| Name of Tissue | P1 | P2 | SP1 | R3 | SP2 | R4 |
|---|---|---|---|---|---|---|
| epithelial | 4.1e−02 | 6.4e−02 | 1.5e−12 | 2.6 | 2.2e−06 | 1.5 |
| general | 1.6e−02 | 1.1e−02 | 1.2e−22 | 4.4 | 7.2e−13 | 2.4 |
| lung | 1 | 6.3e−01 | 1 | 1.0 | 6.2e−01 | 1.6 |
| breast | 8.6e−02 | 1.1e−01 | 3.4e−07 | 1.7 | 2.6e−03 | 1.0 |

As noted above, cluster HSU33147 features 2 transcript(s), which were listed in Table 1 above. These transcript(s) encode for protein(s) which are variant(s) of protein Mammaglobin A precursor (SEQ ID NO:1416). A description of each variant protein according to the present invention is now provided.

Variant protein HSU33147_PEA_1_P5 (SEQ ID NO:1415) according to the present invention has an amino acid sequence as given at the end of the application; it is encoded by transcript(s) HSU33147_PEA_1_1_T1 (SEQ ID NO:1464). An alignment is given to the known protein (Mammaglobin A precursor (SEQ ID NO:1416)) at the end of the application. One or more alignments to one or more previously published protein sequences are given at the end of the application. A brief description of the relationship of the variant protein according to the present invention to each such aligned protein is as follows:

Comparison Report Between HSU33147_PEA_1_P5 (SEQ ID NO:1415) and MGBA_HUMAN (SEQ ID NO:1416):

1. An isolated chimeric polypeptide encoding for HSU33147_PEA_1_P5 (SEQ ID NO:1415), comprising a first amino acid sequence being at least 90% homologous to MKLLMVLMLAALSQHCYAGSGCPLLEN-VISKTINPQVSKTEYKELLQEFIDDNATTNAI DELKECFLNQTDETLSNVE corresponding to amino acids 1-78 of MGBA_HUMAN (SEQ ID NO:1416), which also corresponds to amino acids 1-78 of HSU33147_PEA_1_P5 (SEQ ID NO:1415), and a second amino acid sequence being at least 90% homologous to QLIYDSSLCDLF corresponding to amino acids 82-93 of MGBA_HUMAN (SEQ ID NO:1416), which also corresponds to amino acids 79-90 of HSU33147_PEA_1_P5 (SEQ ID NO:1415), wherein said first amino acid sequence and second amino acid sequence are contiguous and in a sequential order.

2. An isolated chimeric polypeptide encoding for an edge portion of HSU33147_PEA_1_P5 (SEQ ID NO:1415), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EQ, having a structure as follows: a sequence starting from any of amino acid numbers 78-x to 78; and ending at any of amino acid numbers 79+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSU33147_PEA_1_P5 (SEQ ID NO:1415), as compared to the known protein Mammaglobin A precursor (SEQ ID NO:1416), are described in Table 1130 (given according to their position(s) on the amino acid sequence in the first column; the second column indicates whether the glycosylation site is present in the variant protein; and the last column indicates whether the position is different on the variant protein).

TABLE 1130

Glycosylation site(s)

| Position(s) on known amino acid sequence | Present in variant protein? | Position in variant protein? |
|---|---|---|
| 68 | yes | 68 |
| 53 | yes | 53 |

Variant protein HSU33147_PEA_1_P5 (SEQ ID NO:1415) is encoded by the following transcript(s): HSU33147_PEA_1_T1 (SEQ ID NO:1464), for which the sequence(s) is/are given at the end of the application. The coding portion of transcript HSU33147_PEA_1_T1 (SEQ ID NO:1464) is shown in bold; this coding portion starts at position 72 and ends at position 341. The transcript also has the following SNPs as listed in Table 1131 (given according to their position on the nucleotide sequence, with the alternative nucleic acid listed; the last column indicates whether the SNP is known or not; the presence of known SNPs in variant protein HSU33147_PEA_1_P5 (SEQ ID NO:1415) sequence provides support for the deduced sequence of this variant protein according to the present invention).

TABLE 1131

Nucleic acid SNPs

| SNP position on nucleotide sequence | Alternative nucleic acid | Previously known SNP? |
|---|---|---|
| 84 | A -> C | No |
| 124 | C -> | No |
| 396 | A -> G | No |

As noted above, cluster HSU33147 features 5 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSU33147_PEA_1_node_0 (SEQ ID NO:1276) according to the present invention is supported by 38 libraries. The number of libraries was determined as previously described. This segment can be found in the following transcript(s): HSU33147_PEA_1_T1 (SEQ ID NO:1464) and HSU33147_PEA_1_T2 (SEQ ID NO:1465). Table 1132 below describes the starting and ending position of this segment on each transcript.

TABLE 1132

Segment location on transcripts

| Transcript name | Segment starting position | Segment ending position |
|---|---|---|
| HSU33147_PEA_1_T1 (SEQ ID NO: 1464) | 1 | 126 |
| HSU33147_PEA_1_T2 (SEQ ID NO: 1465) | 1 | 126 |

Segment cluster HSU33147_PEA_1_node_2 (SEQ ID NO:1277) according to the present invention is supported by 44 libraries. The number of libraries was determined as previously described. This segment can be found in the following transcript(s): HSU33147_PEA_1_T1 (SEQ ID NO:1464)

and HSU33147_PEA_1_T2 (SEQ ID NO:1465). Table 1133 below describes the starting and ending position of this segment on each transcript.

TABLE 1133

Segment location on transcripts

| Transcript name | Segment starting position | Segment ending position |
|---|---|---|
| HSU33147_PEA_1_T1 (SEQ ID NO: 1464) | 127 | 305 |
| HSU33147_PEA_1_T2 (SEQ ID NO: 1465) | 127 | 305 |

Segment cluster HSU33147_PEA_1_node_4 (SEQ ID NO:1278) according to the present invention is supported by 3 libraries. The number of libraries was determined as previously described. This segment can be found in the following transcript(s): HSU33147_PEA_1_T2 (SEQ ID NO:1465). Table 1134 below describes the starting and ending position of this segment on each transcript.

TABLE 1134

Segment location on transcripts

| Transcript name | Segment starting position | Segment ending position |
|---|---|---|
| HSU33147_PEA_1_T2 (SEQ ID NO: 1465) | 315 | 907 |

Segment cluster HSU33147_PEA_1_node_7 (SEQ ID NO:1279) according to the present invention is supported by 35 libraries. The number of libraries was determined as previously described. This segment can be found in the following transcript(s): HSU33147_PEA_1_T1 (SEQ ID NO:1464). Table 1135 below describes the starting and ending position of this segment on each transcript.

TABLE 1135

Segment location on transcripts

| Transcript name | Segment starting position | Segment ending position |
|---|---|---|
| HSU33147_PEA_1_T1 (SEQ ID NO: 1464) | 306 | 516 |

According to an optional embodiment of the present invention, short segments related to the above cluster are also provided. These segments are up to about 120 bp in length, and so are included in a separate description.

Segment cluster HSU33147_PEA_1_node_3 (SEQ ID NO:1280) according to the present invention can be found in the following transcript(s): HSU33147_PEA_1_T2 (SEQ ID NO:1465). Table 1136 below describes the starting and ending position of this segment on each transcript.

TABLE 1136

Segment location on transcripts

| Transcript name | Segment starting position | Segment ending position |
|---|---|---|
| HSU33147_PEA_1_T2 (SEQ ID NO: 1465) | 306 | 314 |

Variant Protein Alignment to the Previously Known Protein:
Sequence name: MGBA_HUMAN (SEQ ID NO:1416)
Sequence documentation:
Alignment of: HSU33147 PEA_1_P5 (SEQ ID NO:1415) x MGBA_HUMAN (SEQ ID NO:1416) ..
Alignment segment 1/1:

| Quality: | 776.00 | Escore: | 0 |
|---|---|---|---|
| Matching length: | 90 | Total length: | 93 |
| Matching Percent Similarity: | 100.00 | Matching Percent Identity: | 100.00 |
| Total Percent Similarity: | 96.77 | Total Percent Identity: | 96.77 |
| Gaps: | 1 | | |

Alignment:

```
 1  MKLLMVLMLAALSQHCYAGSGCPLLENVISKTINPQVSKTEYKELLQEFI  50
    ||||||||||||||||||||||||||||||||||||||||||||||||||
 1  MKLLMVLMLAALSQHCYAGSGCPLLENVISKTINPQVSKTEYKELLQEFI  50

51  DDNATTNAIDELKECFLNQTDETLSNVE...QLIYDSSLCDLF  90
    |||||||||||||||||||||||||||   ||||||||||||
51  DDNATTNAIDELKECFLNQTDETLSNVEVFMQLIYDSSLCDLF  93
```

Description for Cluster R20779

R20779 features 1 transcript(s) and 24 segment(s) of interest, the names for which are given in Tables 1137 and 1138, respectively, the sequences themselves are given at the end of the application. The selected protein variants are given in table 1139.

TABLE 1137

Transcripts of interest

| Transcript Name | Sequence ID No. |
| --- | --- |
| R20779_T7 | 134 |

TABLE 1138

Segments of interest

| Segment Name | Sequence ID No. |
| --- | --- |
| R20779_node_0 | 913 |
| R20779_node_2 | 914 |
| R20779_node_7 | 915 |
| R20779_node_9 | 916 |
| R20779_node_18 | 917 |
| R20779_node_21 | 918 |
| R20779_node_24 | 919 |
| R20779_node_27 | 920 |
| R20779_node_28 | 921 |
| R20779_node_30 | 922 |
| R20779_node_31 | 923 |
| R20779_node_32 | 924 |
| R20779_node_1 | 925 |
| R20779_node_3 | 926 |
| R20779_node_10 | 927 |
| R20779_node_11 | 928 |
| R20779_node_14 | 929 |
| R20779_node_17 | 930 |
| R20779_node_19 | 931 |
| R20779_node_20 | 932 |
| R20779_node_22 | 933 |
| R20779_node_23 | 934 |
| R20779_node_25 | 935 |
| R20779_node_29 | 936 |

TABLE 1139

Proteins of interest

| Protein Name | Sequence ID No. | Corresponding Transcript(s) |
| --- | --- | --- |
| R20779_P2 | 1402 | R20779_T7 (SEQ ID NO: 134) |

These sequences are variants of the known protein Stanniocalcin 2 precursor (SwissProt accession identifier STC2_HUMAN; known also according to the synonyms STC-2; Stanniocalcin-related protein; STCRP; STC-related protein), SEQ ID NO:1458, referred to herein as the previously known protein.

Protein Stanniocalcin 2 precursor (SEQ ID NO:1458) is known or believed to have the following function(s): Has an anti-hypocalcemic action on calcium and phosphate homeostasis. The sequence for protein Stanniocalcin 2 precursor is given at the end of the application, as "Stanniocalcin 2 precursor amino acid sequence". Protein Stanniocalcin 2 precursor localization is believed to be Secreted (Potential).

The following GO Annotation(s) apply to the previously known protein. The following annotation(s) were found: cell surface receptor linked signal transduction; cell-cell signaling; nutritional response pathway, which are annotation(s) related to Biological Process; hormone, which are annotation (s)related to Molecular Function; and extracellular, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

Cluster R20779 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 44 refer to weighted expression of ESTs in each category, as "parts per million" (ratio of the expression of ESTs for a particular cluster to the expression of all ESTs in that category, according to parts per million).

Figure 44:
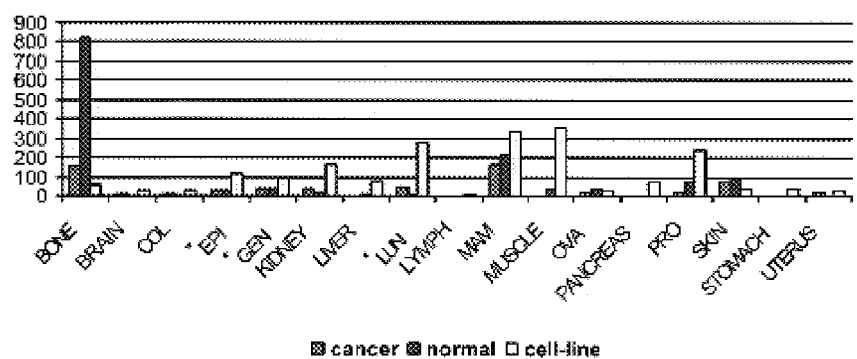
FIG. 44 is a histogram showing Cancer and cell-line vs. normal tissue expression for Cluster R20779, demonstrating overexpression in epithelial malignant tumors, a mixture of malignant tumors from different tissues and lung malignant tumors.

Overall, the following results were obtained as shown with regard to the histograms in FIG. 44 and Table 1140. This cluster is overexpressed (at least at a minimum level) in the following pathological conditions: epithelial malignant tumors, a mixture of malignant tumors from different tissues and lung malignant tumors.

TABLE 1140

Normal tissue distribution

| Name of Tissue | Number |
| --- | --- |
| bone | 825 |
| brain | 0 |
| colon | 0 |
| epithelial | 32 |
| general | 38 |
| kidney | 22 |
| liver | 9 |
| lung | 11 |
| lymph nodes | 0 |
| breast | 215 |
| muscle | 35 |
| ovary | 36 |
| pancreas | 4 |
| prostate | 80 |
| skin | 99 |
| stomach | 0 |
| uterus | 4 |

TABLE 1141

P values and ratios for expression in cancerous tissue

| Name of Tissue | P1 | P2 | SP1 | R3 | SP2 | R4 |
| --- | --- | --- | --- | --- | --- | --- |
| bone | 5.9e−01 | 7.4e−01 | 1 | 0.2 | 1 | 0.1 |
| brain | 2.5e−02 | 1.6e−02 | 2.2e−01 | 6.0 | 3.5e−02 | 8.0 |
| colon | 1.7e−01 | 1.7e−01 | 1 | 1.3 | 7.7e−01 | 1.5 |
| epithelial | 1.7e−01 | 1.5e−03 | 5.9e−01 | 1.0 | 2.0e−04 | 2.0 |
| general | 2.4e−02 | 6.2e−07 | 7.6e−01 | 0.8 | 4.6e−05 | 1.6 |
| kidney | 4.3e−01 | 2.7e−01 | 6.2e−01 | 1.3 | 1.5e−01 | 2.0 |
| liver | 8.3e−01 | 7.6e−01 | 1 | 0.8 | 3.3e−01 | 1.6 |
| lung | 1.2e−01 | 1.4e−03 | 1.9e−01 | 2.9 | 1.6e−05 | 7.7 |
| lymph nodes | 1 | 3.1e−01 | 1 | 1.0 | 1 | 1.4 |
| breast | 6.8e−01 | 6.8e−01 | 6.9e−01 | 0.8 | 3.6e−01 | 0.8 |
| muscle | 9.2e−01 | 4.8e−01 | 1 | 0.3 | 1.4e−03 | 1.4 |
| ovary | 8.4e−01 | 7.1e−01 | 9.0e−01 | 0.7 | 8.6e−01 | 0.8 |
| pancreas | 9.3e−01 | 6.8e−01 | 1 | 0.7 | 1.5e−01 | 2.0 |
| prostate | 9.1e−01 | 5.0e−01 | 9.8e−01 | 0.4 | 5.7e−01 | 0.7 |
| skin | 6.3e−01 | 7.5e−01 | 7.1e−01 | 0.8 | 9.5e−01 | 0.3 |

TABLE 1141-continued

P values and ratios for expression in cancerous tissue

| Name of Tissue | P1 | P2 | SP1 | R3 | SP2 | R4 |
|---|---|---|---|---|---|---|
| stomach | 1 | 4.5e−01 | 1 | 1.0 | 5.1e−01 | 1.8 |
| uterus | 7.1e−01 | 2.6e−01 | 4.4e−01 | 1.7 | 4.1e−01 | 1.8 |

As noted above, cluster R20779 features 1 transcript(s), which were listed in Table 1 above. These transcript(s) encode for protein(s) which are variant(s) of protein Stanniocalcin 2 precursor (SEQ ID NO:1458). A description of each variant protein according to the present invention is now provided.

Variant protein R20779_P2 (SEQ ID NO:1402) according to the present invention has an amino acid sequence as given at the end of the application; it is encoded by transcript(s) R20779_T7 (SEQ ID NO:134). An alignment is given to the known protein (Stanniocalcin 2 precursor (SEQ ID NO:1458)) at the end of the application. One or more alignments to one or more previously published protein sequences are given at the end of the application. A brief description of the relationship of the variant protein according to the present invention to each such aligned protein is as follows:

Comparison Report Between R20779_P2 (SEQ ID NO:1402) and STC2_HUMAN (SEQ ID NO:1458):

1. An isolated chimeric polypeptide encoding for R20779_P2 (SEQ ID NO:1402), comprising a first amino acid sequence being at least 90% homologous to MCAERLGQFMTLALVLATFDPARGTDATNPPEG-PQDRSSQQKGRLSLQNTAEIQHCLV NAGDVGCGV-FECFENNSCEIRGLHGICMTFLHNAGKFDAQGKSF IKDALKCKAHALRH RFGCISRKCPAIREMVSQLQRE-CYLKHDLCAAAQENTRVIVEMIHFKDLLLHE corresponding to amino acids 1-169 of STC2_HUMAN (SEQ ID NO:1458), which also corresponds to amino acids 1-169 of R20779_P2 (SEQ ID NO:1402), and a second amino acid sequence being at least 70%, optionally at least 80%, preferably at least 85%, more preferably at least 90% and most preferably at least 95% homologous to a polypeptide having the sequence CYKIEITMPKRRKVKLRD (SEQ ID NO: 270) corresponding to amino acids 170-187 of R20779_P2 (SEQ ID NO:1402), wherein said first amino acid sequence and second amino acid sequence are contiguous and in a sequential order.

2. An isolated polypeptide encoding for a tail of R20779_P2 (SEQ ID NO:1402), comprising a polypeptide being at least 70%, optionally at least about 80%, preferably at least about 85%, more preferably at least about 90% and most preferably at least about 95% homologous to the sequence CYKIEITMPKRRKVKLRD (SEQ ID NO: 270) in R20779_P2 (SEQ ID NO:1402).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R20779_P2 (SEQ ID NO:1402) also has the following non-silent SNPs (Single Nucleotide Polymorphisms) as listed in Table 1142, (given according to their position(s) on the amino acid sequence, with the alternative amino acid(s) listed; the last column indicates whether the SNP is known or not; the presence of known SNPs in variant protein R20779_P2 (SEQ ID NO:1402) sequence provides support for the deduced sequence of this variant protein according to the present invention).

TABLE 1142

Amino acid mutations

| SNP position(s) on amino acid sequence | Alternative amino acid(s) | Previously known SNP? |
|---|---|---|
| 16 | L -> | No |
| 98 | Q -> | No |
| 171 | Y -> C | Yes |
| 177 | M -> V | Yes |

The glycosylation sites of variant protein R20779_P2 (SEQ ID NO:1402), as compared to the known protein Stanniocalcin 2 precursor (SEQ ID NO:1458), are described in Table 1143 (given according to their position(s) on the amino acid sequence in the first column; the second column indicates whether the glycosylation site is present in the variant protein; and the last column indicates whether the position is different on the variant protein).

TABLE 1143

Glycosylation site(s)

| Position(s) on known amino acid sequence | Present in variant protein? | Position in variant protein? |
|---|---|---|
| 73 | yes | 73 |

Variant protein R20779_P2 (SEQ ID NO:1402) is encoded by the following transcript(s): R20779_T7 (SEQ ID NO:134), for which the sequence(s) is/are given at the end of the application. The coding portion of transcript R20779_T7 (SEQ ID NO:134) is shown in bold; this coding portion starts at position 1397 and ends at position 1957. The transcript also has the following SNPs as listed in Table 1144 (given according to their position on the nucleotide sequence, with the alternative nucleic acid listed; the last column indicates whether the SNP is known or not; the presence of known SNPs in variant protein R20779_P2 (SEQ ID NO:1402) sequence provides support for the deduced sequence of this variant protein according to the present invention).

TABLE 1144

Nucleic acid SNPs

| SNP position on nucleotide sequence | Alternative nucleic acid | Previously known SNP? |
|---|---|---|
| 1442 | T -> | No |
| 1690 | G -> | No |
| 1732 | C -> T | Yes |
| 1867 | G -> T | Yes |
| 1908 | A -> G | Yes |
| 1925 | A -> G | Yes |
| 1968 | G -> A | Yes |
| 2087 | C -> T | No |
| 2138 | C -> T | Yes |
| 2270 | C -> | No |
| 2443 | A -> | No |
| 2478 | G -> | No |
| 2479 | C -> A | No |
| 2616 | C -> A | No |
| 2941 | C -> | No |
| 3196 | -> A | No |
| 3479 | T -> G | Yes |
| 4290 | C -> T | Yes |

TABLE 1144-continued

Nucleic acid SNPs

| SNP position on nucleotide sequence | Alternative nucleic acid | Previously known SNP? |
|---|---|---|
| 4358 | G -> A | Yes |
| 5363 | G -> A | No |

As noted above, cluster R20779 features 24 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R20779_node_0 (SEQ ID NO:913) according to the present invention is supported by 31 libraries. The number of libraries was determined as previously described. This segment can be found in the following transcript(s): R20779_T7 (SEQ ID NO:134). Table 1145 below describes the starting and ending position of this segment on each transcript.

TABLE 1145

Segment location on transcripts

| Transcript name | Segment starting position | Segment ending position |
|---|---|---|
| R20779_T7 (SEQ ID NO: 134) | 1 | 1298 |

Segment cluster R20779_node_2 (SEQ ID NO:914) according to the present invention is supported by 55 libraries. The number of libraries was determined as previously described. This segment can be found in the following transcript(s): R20779_T7 (SEQ ID NO:134). Table 1146 below describes the starting and ending position of this segment on each transcript.

TABLE 1146

Segment location on transcripts

| Transcript name | Segment starting position | Segment ending position |
|---|---|---|
| R20779_T7 (SEQ ID NO: 134) | 1337 | 1506 |

Segment cluster R20779_node_7 (SEQ ID NO:915) according to the present invention is supported by 63 libraries. The number of libraries was determined as previously described. This segment can be found in the following transcript(s): R20779_T7 (SEQ ID NO:134). Table 1147 below describes the starting and ending position of this segment on each transcript.

TABLE 1147

Segment location on transcripts

| Transcript name | Segment starting position | Segment ending position |
|---|---|---|
| R20779_T7 (SEQ ID NO: 134) | 1548 | 1690 |

Segment cluster R20779_node_9 (SEQ ID NO:916) according to the present invention is supported by 66 libraries. The number of libraries was determined as previously described. This segment can be found in the following transcript(s): R20779_T7 (SEQ ID NO:134). Table 1148 below describes the starting and ending position of this segment on each transcript.

TABLE 1148

Segment location on transcripts

| Transcript name | Segment starting position | Segment ending position |
|---|---|---|
| R20779_T7 (SEQ ID NO: 134) | 1691 | 1838 |

Segment cluster R20779_node_18 (SEQ ID NO:917) according to the present invention is supported by 61 libraries. The number of libraries was determined as previously described. This segment can be found in the following transcript(s): R20779_T7 (SEQ ID NO:134). Table 1149 below describes the starting and ending position of this segment on each transcript.

TABLE 1149

Segment location on transcripts

| Transcript name | Segment starting position | Segment ending position |
|---|---|---|
| R20779_T7 (SEQ ID NO: 134) | 2009 | 2176 |

Segment cluster R20779_node_21 (SEQ ID NO:918) according to the present invention is supported by 106 libraries. The number of libraries was determined as previously described. This segment can be found in the following transcript(s): R20779_T7 (SEQ ID NO:134). Table 1150 below describes the starting and ending position of this segment on each transcript.

TABLE 1150

Segment location on transcripts

| Transcript name | Segment starting position | Segment ending position |
|---|---|---|
| R20779_T7 (SEQ ID NO: 134) | 2219 | 2796 |

Segment cluster R20779_node_24 (SEQ ID NO:919) according to the present invention is supported by 100 libraries. The number of libraries was determined as previously described. This segment can be found in the following transcript(s): R20779_T7 (SEQ ID NO:134). Table 1151 below describes the starting and ending position of this segment on each transcript.

TABLE 1151

Segment location on transcripts

| Transcript name | Segment starting position | Segment ending position |
|---|---|---|
| R20779_T7 (SEQ ID NO: 134) | 2977 | 3667 |

Segment cluster R20779_node_27 (SEQ ID NO:920) according to the present invention is supported by 26 libraries. The number of libraries was determined as previously described. This segment can be found in the following transcript(s): R20779_T7 (SEQ ID NO:134). Table 1152 below describes the starting and ending position of this segment on each transcript.

TABLE 1152

Segment location on transcripts

| Transcript name | Segment starting position | Segment ending position |
|---|---|---|
| R20779_T7 (SEQ ID NO: 134) | 3673 | 3803 |

Segment cluster R20779_node__28 (SEQ ID NO:921) according to the present invention is supported by 31 libraries. The number of libraries was determined as previously described. This segment can be found in the following transcript(s): R20779_T7 (SEQ ID NO:134). Table 1153 below describes the starting and ending position of this segment on each transcript.

TABLE 1153

Segment location on transcripts

| Transcript name | Segment starting position | Segment ending position |
|---|---|---|
| R20779_T7 (SEQ ID NO: 134) | 3804 | 4050 |

Segment cluster R20779_node__30 (SEQ ID NO:922) according to the present invention is supported by 34 libraries. The number of libraries was determined as previously described. This segment can be found in the following transcript(s): R20779_T7 (SEQ ID NO:134). Table 1154 below describes the starting and ending position of this segment on each transcript.

TABLE 1154

Segment location on transcripts

| Transcript name | Segment starting position | Segment ending position |
|---|---|---|
| R20779_T7 (SEQ ID NO: 134) | 4068 | 4193 |

Segment cluster R20779_node__31 (SEQ ID NO:923) according to the present invention is supported by 46 libraries. The number of libraries was determined as previously described. This segment can be found in the following transcript(s): R20779_T7 (SEQ ID NO:134). Table 1155 below describes the starting and ending position of this segment on each transcript.

TABLE 1155

Segment location on transcripts

| Transcript name | Segment starting position | Segment ending position |
|---|---|---|
| R20779_T7 (SEQ ID NO: 134) | 4194 | 4424 |

Segment cluster R20779_node__32 (SEQ ID NO:924) according to the present invention is supported by 88 libraries. The number of libraries was determined as previously described. This segment can be found in the following transcript(s): R20779_T7 (SEQ ID NO:134). Table 1156 below describes the starting and ending position of this segment on each transcript.

TABLE 1156

Segment location on transcripts

| Transcript name | Segment starting position | Segment ending position |
|---|---|---|
| R20779_T7 (SEQ ID NO: 134) | 4425 | 5503 |

According to an optional embodiment of the present invention, short segments related to the above cluster are also provided. These segments are up to about 120 bp in length, and so are included in a separate description.

Segment cluster R20779_node__1 (SEQ ID NO:925) according to the present invention is supported by 27 libraries. The number of libraries was determined as previously described. This segment can be found in the following transcript(s): R20779_T7 (SEQ ID NO:134). Table 1157 below describes the starting and ending position of this segment on each transcript.

TABLE 1157

Segment location on transcripts

| Transcript name | Segment starting position | Segment ending position |
|---|---|---|
| R20779_T7 (SEQ ID NO: 134) | 1299 | 1336 |

Segment cluster R20779_node__3 (SEQ ID NO:926) according to the present invention is supported by 52 libraries. The number of libraries was determined as previously described. This segment can be found in the following transcript(s): R20779_T7 (SEQ ID NO:134). Table 1158 below describes the starting and ending position of this segment on each transcript.

TABLE 1158

Segment location on transcripts

| Transcript name | Segment starting position | Segment ending position |
|---|---|---|
| R20779_T7 (SEQ ID NO: 134) | 1507 | 1547 |

Segment cluster R20779_node__10 (SEQ ID NO:927) according to the present invention can be found in the following transcript(s): R20779_T7 (SEQ ID NO:134). Table 1159 below describes the starting and ending position of this segment on each transcript.

TABLE 1159

Segment location on transcripts

| Transcript name | Segment starting position | Segment ending position |
|---|---|---|
| R20779_T7 (SEQ ID NO: 134) | 1839 | 1849 |

Segment cluster R20779_node__11 (SEQ ID NO:928) according to the present invention is supported by 58 libraries. The number of libraries was determined as previously described. This segment can be found in the following transcript(s): R20779_T7 (SEQ ID NO:134). Table 1160 below describes the starting and ending position of this segment on each transcript.

TABLE 1160

Segment location on transcripts

| Transcript name | Segment starting position | Segment ending position |
|---|---|---|
| R20779_T7 (SEQ ID NO: 134) | 1850 | 1902 |

Segment cluster R20779_node_14 (SEQ ID NO:929) according to the present invention is supported by 1 libraries. The number of libraries was determined as previously described. This segment can be found in the following transcript(s): R20779_T7 (SEQ ID NO:134). Table 1161 below describes the starting and ending position of this segment on each transcript.

TABLE 1161

Segment location on transcripts

| Transcript name | Segment starting position | Segment ending position |
|---|---|---|
| R20779_T7 (SEQ ID NO: 134) | 1903 | 1975 |

Segment cluster R20779_node_17 (SEQ ID NO:930) according to the present invention is supported by 54 libraries. The number of libraries was determined as previously described. This segment can be found in the following transcript(s): R20779_T7 (SEQ ID NO:134). Table 1162 below describes the starting and ending position of this segment on each transcript.

TABLE 1162

Segment location on transcripts

| Transcript name | Segment starting position | Segment ending position |
|---|---|---|
| R20779_T7 (SEQ ID NO: 134) | 1976 | 2008 |

Segment cluster R20779_node_19 (SEQ ID NO:931) according to the present invention can be found in the following transcript(s): R20779_T7 (SEQ ID NO:134). Table 1163 below describes the starting and ending position of this segment on each transcript.

TABLE 1163

Segment location on transcripts

| Transcript name | Segment starting position | Segment ending position |
|---|---|---|
| R20779_T7 (SEQ ID NO: 134) | 2177 | 2188 |

Segment cluster R20779_node_20 (SEQ ID NO:932) according to the present invention is supported by 53 libraries. The number of libraries was determined as previously described. This segment can be found in the following transcript(s): R20779_T7 (SEQ ID NO:134). Table 1164 below describes the starting and ending position of this segment on each transcript.

TABLE 1164

Segment location on transcripts

| Transcript name | Segment starting position | Segment ending position |
|---|---|---|
| R20779_T7 (SEQ ID NO: 134) | 2189 | 2218 |

Segment cluster R20779_node_22 (SEQ ID NO:933) according to the present invention is supported by 76 libraries. The number of libraries was determined as previously described. This segment can be found in the following transcript(s): R20779_T7 (SEQ ID NO:134). Table 1165 below describes the starting and ending position of this segment on each transcript.

TABLE 1165

Segment location on transcripts

| Transcript name | Segment starting position | Segment ending position |
|---|---|---|
| R20779_T7 (SEQ ID NO: 134) | 2797 | 2899 |

Segment cluster R20779_node_23 (SEQ ID NO:934) according to the present invention is supported by 81 libraries. The number of libraries was determined as previously described. This segment can be found in the following transcript(s): R20779_T7 (SEQ ID NO:134). Table 1166 below describes the starting and ending position of this segment on each transcript.

TABLE 1166

Segment location on transcripts

| Transcript name | Segment starting position | Segment ending position |
|---|---|---|
| R20779_T7 (SEQ ID NO: 134) | 2900 | 2976 |

Segment cluster R20779_node_25 (SEQ ID NO:935) according to the present invention can be found in the following transcript(s): R20779_T7 (SEQ ID NO:134). Table 1167 below describes the starting and ending position of this segment on each transcript.

TABLE 1167

Segment location on transcripts

| Trascript name | Segment starting position | Segment ending position |
|---|---|---|
| R20779_T7 (SEQ ID NO: 134) | 3668 | 3672 |

Segment cluster R20779_node_29 (SEQ ID NO:936) according to the present invention can be found in the following transcript(s): R20779_T7 (SEQ ID NO:134). Table 1168 below describes the starting and ending position of this segment on each transcript.

TABLE 1168

Segment location on transcripts

| Transcript name | Segment starting position | Segment ending position |
|---|---|---|
| R20779_T7 (SEQ ID NO: 134) | 4051 | 4067 |

Variant Protein Alignment to the Previously Known Protein:
Sequence name: STC2_HUMAN (SEQ ID NO:1458)
Sequence documentation:
Alignment of: R20779_P2 (SEQ ID NO:1402) x STC2_HUMAN (SEQ ID NO:1458) ..
Alignment segment 1/1:

| | | | |
|---|---|---|---|
| Quality: | 1688.00 | Escore: | 0 |
| Matching length: | 171 | Total length: | 171 |
| Matching Percent Similarity: | 99.42 | Matching Percent Identity: | 99.42 |
| Total Percent Similarity: | 99.42 | Total Percent Identity: | 99.42 |
| Gaps: | 0 | | |

Alignment:

```
  1 MCAERLGQFMTLALVLATFDPARGTDATNPPEGPQDRSSQQKGRLSLQNT  50
    |||||||||||||||||||||||||||||||||||||||||||||||||
  1 MCAERLGQFMTLALVLATFDPARGTDATNPPEGPQDRSSQQKGRLSLQNT  50

51 AEIQHCLVNAGDVGCGVFECFENNSCEIRGLHGICMTFLHNAGKFDAQGK 100
    |||||||||||||||||||||||||||||||||||||||||||||||||
 51 AEIQHCLVNAGDVGCGVFECFENNSCEIRGLHGICMTFLHNAGKFDAQGK 100

101 SFIKDALKCKAHALRHRFGCISRKCPAIREMVSQLQRECYLKHDLCAAAQ 150
    |||||||||||||||||||||||||||||||||||||||||||||||||
101 SFIKDALKCKAHALRHRFGCISRKCPAIREMVSQLQRECYLKHDLCAAAQ 150

151 ENTRVIVEMIHFKDLLLHECY                             171
    ||||||||||||||||||| |
151 ENTRVIVEMIHFKDLLLHEPY                             171
```

Description for Cluster R38144

Cluster R38144 features 6 transcript(s) and 24 segment(s) of interest, the names for which are given in Tables 1169 and 1170, respectively, the sequences themselves are given at the end of the application. The selected protein variants are given in table 1171.

TABLE 1169

Transcripts of interest

| Transcript Name | Sequence ID No. |
|---|---|
| R38144_PEA_2_T6 | 135 |
| R38144_PEA_2_T10 | 136 |
| R38144_PEA_2_T13 | 137 |
| R38144_PEA_2_T15 | 138 |

TABLE 1169-continued

Transcripts of interest

| Transcript Name | Sequence ID No. |
|---|---|
| R38144_PEA_2_T19 | 139 |
| R38144_PEA_2_T27 | 140 |

TABLE 1170

Segments of interest

| Segment Name | Sequence ID No. |
|---|---|
| R38144_PEA_2_node_21 | 937 |
| R38144_PEA_2_node_26 | 938 |
| R38144_PEA_2_node_29 | 939 |
| R38144_PEA_2_node_31 | 940 |
| R38144_PEA_2_node_46 | 941 |
| R38144_PEA_2_node_47 | 942 |
| R38144_PEA_2_node_49 | 943 |
| R38144_PEA_2_node_0 | 944 |
| R38144_PEA_2_node_1 | 945 |
| R38144_PEA_2_node_4 | 946 |
| R38144_PEA_2_node_5 | 947 |
| R38144_PEA_2_node_7 | 948 |
| R38144_PEA_2_node_11 | 949 |
| R38144_PEA_2_node_14 | 950 |
| R38144_PEA_2_node_15 | 951 |
| R38144_PEA_2_node_16 | 952 |
| R38144_PEA_2_node_19 | 953 |
| R38144_PEA_2_node_20 | 954 |

TABLE 1170-continued

Segments of interest

| Segment Name | Sequence ID No. |
|---|---|
| R38144_PEA_2_node_36 | 955 |
| R38144_PEA_2_node_37 | 956 |
| R38144_PEA_2_node_43 | 957 |
| R38144_PEA_2_node_44 | 958 |
| R38144_PEA_2_node_45 | 959 |
| R38144_PEA_2_node_51 | 960 |

TABLE 1171

Proteins of interest

| Protein Name | Sequence ID No. | Corresponding Transcript(s) |
|---|---|---|
| R38144_PEA_2_P6 | 1403 | R38144_PEA_2_T6 (SEQ ID NO: 135) |
| R38144_PEA_2_P13 | 1404 | R38144_PEA_2_T13 (SEQ ID NO: 137) |
| R38144_PEA_2_P15 | 1405 | R38144_PEA_2_T15 (SEQ ID NO: 138) |
| R38144_PEA_2_P19 | 1406 | R38144_PEA_2_T19 (SEQ ID NO: 139) |
| R38144_PEA_2_P24 | 1407 | R38144_PEA_2_T27 (SEQ ID NO: 140) |
| R38144_PEA_2_P36 | 1408 | R38144_PEA_2_T10 (SEQ ID NO: 136) |

These sequences are variants of the known protein Putative alpha-mannosidase C20orf31 precursor (SwissProt accession identifier CT31_HUMAN; known also according to the synonyms EC 3.2.1), SEQ ID NO:1459, referred to herein as the previously known protein.

The sequence for protein Putative alpha-mannosidase C20orf31 precursor (SEQ ID NO:1459) is given at the end of the application, as "Putative alpha-mannosidase C20orf31 precursor amino acid sequence". Known polymorphisms for this sequence are as shown in Table 1172.

TABLE 1172

Amino acid mutations for Known Protein

| SNP position(s) on amino acid sequence | Comment |
|---|---|
| 456 | A -> T. /FTId = VAR_012165. |
| 511 | S -> C |

Protein Putative alpha-mannosidase C20orf31 precursor (SEQ ID NO:1459) localization is believed to be Secreted (Potential).

The following GO Annotation(s) apply to the previously known protein. The following annotation(s) were found: carbohydrate metabolism; N-linked glycosylation, which are annotation(s) related to Biological Process; mannosyl-oligosaccharide 1,2-alpha-mannosidase; calcium binding; hydrolase, acting on glycosyl bonds, which are annotation(s) related to Molecular Function; and membrane, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster R38144 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 45 refer to weighted expression of ESTs in each category, as "parts per million" (ratio of the expression of ESTs for a particular cluster to the expression of all ESTs in that category, according to parts per million).

Figure 45:
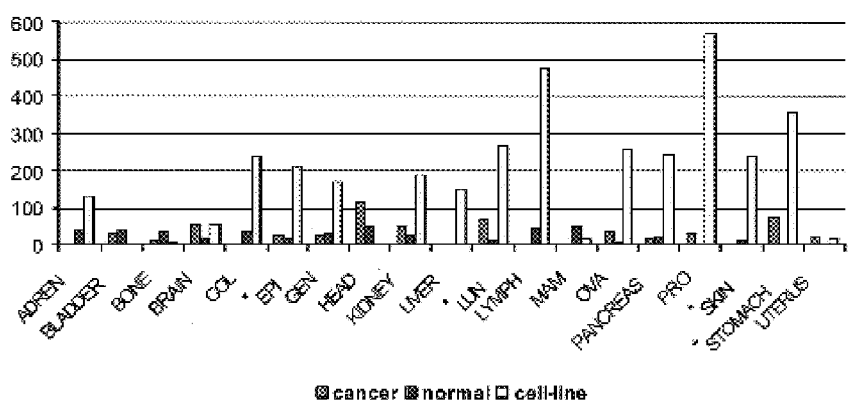
FIG. 45 is a histogram showing Cancer and cell-line vs. normal tissue expression for Cluster R38144, demonstrating overexpression in epithelial malignant tumors, lung malignant tumors, skin malignancies and gastric carcinoma.

Overall, the following results were obtained as shown with regard to the histograms in FIG. 45 and Table 1173. This cluster is overexpressed (at least at a minimum level) in the following pathological conditions: epithelial malignant tumors, lung malignant tumors, skin malignancies and gastric carcinoma.

TABLE 1173

Normal tissue distribution

| Name of Tissue | Number |
|---|---|
| Adrenal | 40 |
| Bladder | 41 |
| Bone | 38 |
| Brain | 16 |
| Colon | 37 |
| Epithelial | 18 |
| General | 31 |
| head and neck | 50 |
| Kidney | 26 |
| Liver | 4 |
| Lung | 11 |
| lymph nodes | 47 |
| Breast | 52 |
| Ovary | 7 |
| Pancreas | 20 |
| Prostate | 0 |
| Skin | 13 |
| Stomach | 0 |
| Uterus | 0 |

TABLE 1174

P values and ratios for expression in cancerous tissue

| Name of Tissue | P1 | P2 | SP1 | R3 | SP2 | R4 |
|---|---|---|---|---|---|---|
| Adrenal | 9.2e−01 | 6.9e−01 | 1 | 0.5 | 7.8e−01 | 0.9 |
| Bladder | 7.6e−01 | 8.1e−01 | 8.1e−01 | 0.9 | 9.0e−01 | 0.7 |
| Bone | 6.6e−01 | 8.5e−01 | 1 | 0.6 | 1 | 0.6 |
| Brain | 8.0e−02 | 6.0e−02 | 4.7e−02 | 3.0 | 1.6e−02 | 3.0 |
| colon | 7.7e−01 | 7.5e−01 | 1 | 0.5 | 3.5e−01 | 0.8 |
| epithelial | 2.0e−01 | 4.8e−03 | 1.7e−01 | 1.4 | 2.7e−16 | 5.2 |
| general | 3.9e−01 | 2.2e−02 | 7.8e−01 | 0.9 | 2.1e−19 | 2.9 |
| head and neck | 3.4e−01 | 5.6e−01 | 4.6e−01 | 1.4 | 7.5e−01 | 0.9 |
| kidney | 8.3e−01 | 7.7e−01 | 4.4e−01 | 1.4 | 8.5e−02 | 1.6 |
| liver | 9.1e−01 | 6.0e−01 | 1 | 0.9 | 1.1e−01 | 1.8 |
| lung | 1.6e−02 | 1.5e−02 | 9.5e−02 | 3.8 | 1.6e−05 | 6.6 |
| lymph nodes | 7.1e−01 | 7.8e−01 | 1 | 0.3 | 1.2e−04 | 1.0 |
| breast | 9.1e−01 | 9.1e−01 | 1 | 0.5 | 9.7e−01 | 0.6 |
| ovary | 5.0e−01 | 2.9e−01 | 4.7e−01 | 1.7 | 7.0e−02 | 2.2 |
| pancreas | 7.2e−01 | 4.2e−01 | 8.1e−01 | 0.8 | 3.0e−02 | 1.8 |
| prostate | 7.9e−01 | 5.7e−01 | 3.0e−01 | 2.5 | 1.8e−04 | 3.0 |
| skin | 9.2e−01 | 8.7e−02 | 1 | 0.5 | 3.0e−05 | 4.1 |
| stomach | 3.0e−01 | 5.5e−02 | 2.5e−01 | 3.0 | 9.2e−04 | 6.1 |
| uterus | 2.1e−01 | 9.4e−02 | 4.4e−01 | 2.0 | 5.1e−01 | 1.9 |

As noted above, cluster R38144 features 6 transcript(s), which were listed in Table 1 above. These transcript(s) encode for protein(s) which are variant(s) of protein Putative alpha-mannosidase C20orf31 precursor (SEQ ID NO:1459). A description of each variant protein according to the present invention is now provided.

Variant protein R38144_PEA_2_P6 (SEQ ID NO:1403) according to the present invention has an amino acid sequence as given at the end of the application; it is encoded by transcript(s) R38144_PEA_2_T6 (SEQ ID NO:135). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison Report Between R38144_PEA_2_P6 (SEQ ID NO:1403) and CT31_HUMAN (SEQ ID NO:1459):

1. An isolated chimeric polypeptide encoding for R38144_PEA_2_P6 (SEQ ID NO:1403), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLEYNKAIRNYTR FDDW-YLWVQMYKGTVSMPVFQSLEAYWPGLQS-LIGDIDNAMRTFLNYYTVWKQFGG LPEFYNIPQGYTVEKREGYPLRPELIE-SAMYLYRATGDPTLLELGRDAVESIEKISKVEC GFAT corresponding to amino acids 1-412 of CT31_HUMAN (SEQ ID NO:1459), which also corresponds to amino acids 1-412 of R38144_PEA_2_P6 (SEQ ID NO:1403), and a second amino acid sequence being at least 70%, optionally at least 80%, preferably at least 85%, more preferably at least 90% and most preferably at least 95% homologous to a polypeptide having the sequence LASFSHMSDQRSAR-PQAGQPHGVVLPGRDCEIPLPPV (SEQ ID NO: 268) corresponding to amino acids 413-449 of R38144_PEA_2_P6 (SEQ ID NO:1403), wherein said first amino acid sequence and second amino acid sequence are contiguous and in a sequential order.

2. An isolated polypeptide encoding for a tail of R38144_PEA_2_P6 (SEQ ID NO:1403), comprising a polypeptide being at least 70%, optionally at least about 80%, preferably at least about 85%, more preferably at least about 90% and most preferably at least about 95% homologous to the sequence LASFSHMSDQRSARPQAGQPHGVV-LPGRDCEIPLPPV (SEQ ID NO: 268) in R38144_PEA_2_P6 (SEQ ID NO:1403).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P6 (SEQ ID NO:1403) also has the following non-silent SNPs (Single Nucleotide Polymorphisms) as listed in Table 1175, (given according to their position(s) on the amino acid sequence, with the alternative amino acid(s) listed; the last column indicates whether the SNP is known or not; the presence of known SNPs in variant protein R38144_PEA_2_P6 (SEQ ID NO:1403) sequence provides support for the deduced sequence of this variant protein according to the present invention).

TABLE 1175

| | Amino acid mutations | |
|---|---|---|
| SNP position(s) on amino acid sequence | Alternative amino acid(s) | Previously known SNP? |
| 10 | G -> | No |
| 54 | A -> V | Yes |
| 55 | F -> L | Yes |
| 73 | S -> I | Yes |
| 87 | I -> | No |
| 145 | P -> | No |
| 145 | P -> A | No |
| 164 | A -> G | No |
| 164 | A -> | No |
| 203 | A -> G | No |
| 203 | A -> | No |
| 211 | D -> | No |
| 236 | G -> | No |
| 265 | V -> G | No |
| 285 | K -> | No |
| 294 | D -> N | No |
| 305 | G -> E | No |
| 323 | Q -> R | No |
| 346 | F -> | No |

The glycosylation sites of variant protein R38144_PEA_2_P6 (SEQ ID NO:1403), as compared to the known protein Putative alpha-mannosidase C20orf31 precursor (SEQ ID NO:1459), are described in Table 1176 (given according to their position(s) on the amino acid sequence in the first column; the second column indicates whether the glycosylation site is present in the variant protein; and the last column indicates whether the position is different on the variant protein).

TABLE 1176

| | Glycosylation site(s) | |
|---|---|---|
| Position(s) on known amino acid sequence | Present in variant protein? | Position in variant protein? |
| 450 | no | |
| 289 | yes | 289 |
| 112 | yes | 112 |
| 90 | yes | 90 |

Variant protein R38144_PEA_2_P6 (SEQ ID NO:1403) is encoded by the following transcript(s): R38144_PEA_2_T6 (SEQ ID NO:135), for which the sequence(s) is/are given at the end of the application. The coding portion of transcript R38144_PEA_2_T6 (SEQ ID NO:135) is shown in bold; this coding portion starts at position 91 and ends at position 1437. The transcript also has the following SNPs as listed in Table 1177 (given according to their position on the nucleotide sequence, with the alternative nucleic acid listed; the last column indicates whether the SNP is known or not; the presence of known SNPs in variant protein R38144_PEA_2_P6 (SEQ ID NO:1403) sequence provides support for the deduced sequence of this variant protein according to the present invention).

TABLE 1177

Nucleic acid SNPs

| SNP position on nucleotide sequence | Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 943 | A -> | No |
| 970 | G -> A | No |
| 1004 | G -> A | No |
| 1058 | A -> G | No |
| 1126 | T -> | No |
| 1218 | C -> T | Yes |
| 1392 | A -> G | No |
| 1425 | T -> C | No |
| 1481 | G -> A | Yes |
| 1560 | C -> T | No |
| 1566 | C -> | No |
| 1644 | G -> A | Yes |
| 1646 | A -> T | No |
| 1763 | A -> | No |
| 1763 | A -> C | No |
| 1781 | C -> T | Yes |
| 1799 | C -> | No |
| 1799 | C -> G | No |
| 1844 | T -> G | No |
| 1855 | A -> C | Yes |

Variant protein R38144_PEA_2_P13 (SEQ ID NO:1404) according to the present invention has an amino acid sequence as given at the end of the application; it is encoded by transcript(s) R38144_PEA_2_T13 (SEQ ID NO:137). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison Report Between R38144_PEA_2_P13 (SEQ ID NO:1404) and CT31_HUMAN (SEQ ID NO:1459):

1. An isolated chimeric polypeptide encoding for R38144_PEA_2_P13 (SEQ ID NO:1404), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLEYNKAIRNYTR FDDW-YLWVQMYKGTVSMPVFQSLEAYWPGLQ corresponding to amino acids 1-323 of CT31_HUMAN (SEQ ID NO:1459), which also corresponds to amino acids 1-323 of R38144_PEA_2_P13 (SEQ ID NO:1404), and a second amino acid sequence being at least 70%, optionally at least 80%, preferably at least 85%, more preferably at least 90% and most preferably at least 95% homologous to a polypeptide having the sequence NLLKAQCTSTVPRGIPPS (SEQ ID NO: 269) corresponding to amino acids 324-341 of R38144_PEA_2_P13 (SEQ ID NO:1404), wherein said first amino acid sequence and second amino acid sequence are contiguous and in a sequential order.

2. An isolated polypeptide encoding for a tail of R38144_PEA_2_P113 (SEQ ID NO:1404), comprising a polypeptide being at least 70%, optionally at least about 80%, preferably at least about 85%, more preferably at least about 90% and most preferably at least about 95% homologous to the sequence NLLKAQCTSTVPRGIPPS (SEQ ID NO: 269) in R38144_PEA_2_P13 (SEQ ID NO:1404).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P13 (SEQ ID NO:1404) also has the following non-silent SNPs (Single Nucleotide Polymorphisms) as listed in Table 1178, (given according to their position(s) on the amino acid sequence, with the alternative amino acid(s) listed; the last column indicates whether the SNP is known or not; the presence of known SNPs in variant protein R38144_PEA_2_P13 (SEQ ID NO:1404) sequence provides support for the deduced sequence of this variant protein according to the present invention).

TABLE 1178

Amino acid mutations

| SNP position(s) on amino acid sequence | Alternative amino acid(s) | Previously known SNP? |
|---|---|---|
| 10 | G -> | No |
| 54 | A -> V | Yes |
| 55 | F -> L | Yes |
| 73 | S -> I | Yes |
| 87 | I -> | No |
| 145 | P -> | No |
| 145 | P -> A | No |
| 164 | A -> G | No |
| 164 | A -> | No |
| 203 | A -> G | No |
| 203 | A -> | No |
| 211 | D -> | No |
| 236 | G -> | No |
| 265 | V -> G | No |
| 285 | K -> | No |
| 294 | D -> N | No |
| 305 | G -> E | No |
| 323 | Q -> R | No |
| 328 | A -> V | Yes |

The glycosylation sites of variant protein R38144_PEA_2_P13 (SEQ ID NO:1404), as compared to the known protein Putative alpha-mannosidase C20orf31 precursor (SEQ ID NO:1459), are described in Table 1179 (given according to their position(s) on the amino acid sequence in the first column; the second column indicates whether the glycosylation site is present in the variant protein; and the last column indicates whether the position is different on the variant protein).

TABLE 1179

| Position(s) on known amino acid sequence | Glycosylation site(s) Present in variant protein? | Position in variant protein? |
|---|---|---|
| 450 | no | |
| 289 | yes | 289 |
| 112 | yes | 112 |
| 90 | yes | 90 |

Variant protein R38144_PEA_2_P13 (SEQ ID NO:1404) is encoded by the following transcript(s): R38144_PEA_2_T13 (SEQ ID NO:137), for which the sequence(s) is/are given at the end of the application. The coding portion of transcript R38144_PEA_2_T13 (SEQ ID NO:137) is shown in bold; this coding portion starts at position 91 and ends at position 1113. The transcript also has the following SNPs as listed in Table 1180 (given according to their position on the nucleotide sequence, with the alternative nucleic acid listed; the last column indicates whether the SNP is known or not; the presence of known SNPs in variant protein R38144_PEA_2_P13 (SEQ ID NO:1404) sequence provides support for the deduced sequence of this variant protein according to the present invention).

TABLE 1180

| SNP position on nucleotide sequence | Nucleic acid SNPs Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 943 | A -> | No |
| 970 | G -> A | No |
| 1004 | G -> A | No |
| 1058 | A -> G | No |
| 1073 | C -> T | Yes |
| 1222 | A -> G | No |
| 1255 | T -> C | No |
| 1311 | G -> A | Yes |
| 1390 | C -> T | No |
| 1396 | C -> | No |
| 1474 | G -> A | Yes |
| 1476 | A -> T | No |
| 1593 | A -> | No |
| 1593 | A -> C | No |
| 1611 | C -> T | Yes |
| 1629 | C -> | No |
| 1629 | C -> G | No |

TABLE 1180-continued

| SNP position on nucleotide sequence | Nucleic acid SNPs Alternative nucleic acid | Previously known SNP? |
|---|---|---|
| 1674 | T -> G | No |
| 1685 | A -> C | Yes |

Variant protein R38144_PEA_2_P15 (SEQ ID NO:1405) according to the present invention has an amino acid sequence as given at the end of the application; it is encoded by transcript(s) R38144_PEA_2_T15 (SEQ ID NO:138). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison Report Between R38144_PEA_2_P15 (SEQ ID NO:1405) and CT31_HUMAN (SEQ ID NO:1459):

1. An isolated chimeric polypeptide encoding for R38144_PEA_2_P15 (SEQ ID NO:1405), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLE corresponding to amino acids 1-282 of CT31_HUMAN (SEQ ID NO:1459), which also corresponds to amino acids 1-282 of R38144_PEA_2_P15 (SEQ ID NO:1405), and a second amino acid sequence being at least 70%, optionally at least 80%, preferably at least 85%, more preferably at least 90% and most preferably at least 95% homologous to a polypeptide having the sequence PHWRH (SEQ ID NO: 270) corresponding to amino acids 283-287 of R38144_PEA_2_P15 (SEQ ID NO:1405), wherein said first amino acid sequence and second amino acid sequence are contiguous and in a sequential order.

2. An isolated polypeptide encoding for a tail of R38144_PEA_2_P15 (SEQ ID NO:1405), comprising a polypeptide being at least 70%, optionally at least about 80%, preferably at least about 85%, more preferably at least about 90% and most preferably at least about 95% homologous to the sequence PHWRH (SEQ ID NO: 270) in R38144_PEA_2_P15 (SEQ ID NO:1405).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P15 (SEQ ID NO:1405) also has the following non-silent SNPs (Single Nucleotide Polymorphisms) as listed in Table 1181, (given according to their position(s) on the amino acid sequence, with the alternative amino acid(s) listed; the last column indicates whether the SNP is known or not; the presence of known SNPs in variant protein R38144_PEA_2_P15 (SEQ ID NO:1405) sequence provides support for the deduced sequence of this variant protein according to the present invention).

TABLE 1181

Amino acid mutations

| SNP position(s) on amino acid sequence | Alternative amino acid(s) | Previously known SNP? |
|---|---|---|
| 10 | G -> | No |
| 54 | A -> V | Yes |
| 55 | F -> L | Yes |
| 73 | S -> I | Yes |
| 87 | I -> | No |
| 145 | P -> | No |
| 145 | P -> A | No |
| 164 | A -> G | No |
| 164 | A -> | No |
| 203 | A -> G | No |
| 203 | A -> | No |
| 211 | D -> | No |
| 236 | G -> | No |
| 265 | V -> G | No |

The glycosylation sites of variant protein R38144_PEA_2_P15 (SEQ ID NO:1405), as compared to the known protein Putative alpha-mannosidase C20orf31 precursor (SEQ ID NO:1459), are described in Table 1182 (given according to their position(s) on the amino acid sequence in the first column; the second column indicates whether the glycosylation site is present in the variant protein; and the last column indicates whether the position is different on the variant protein).

TABLE 1182

Glycosylation site(s)

| Position(s) on known amino acid sequence | Present in variant protein? | Position in variant protein? |
|---|---|---|
| 450 | no | |
| 289 | no | |
| 112 | yes | 112 |
| 90 | yes | 90 |

Variant protein R38144_PEA_2_P15 (SEQ ID NO:1405) is encoded by the following transcript(s): R38144_PEA_2_T15 (SEQ ID NO:138), for which the sequence(s) is/are given at the end of the application. The coding portion of transcript R38144_PEA_2_T15 (SEQ ID NO:138) is shown in bold; this coding portion starts at position 91 and ends at position 951. The transcript also has the following SNPs as listed in Table 1183 (given according to their position on the nucleotide sequence, with the alternative nucleic acid listed; the last column indicates whether the SNP is known or not; the presence of known SNPs in variant protein R38144_PEA_2_P15 (SEQ ID NO:1405) sequence provides support for the deduced sequence of this variant protein according to the present invention).

TABLE 1183

Nucleic acid SNPs

| SNP position on nucleotide sequence | Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 1001 | T -> | No |
| 1093 | C -> T | Yes |
| 1242 | A -> G | No |
| 1275 | T -> C | No |
| 1331 | G -> A | Yes |
| 1410 | C -> T | No |
| 1416 | C -> | No |
| 1494 | G -> A | Yes |
| 1496 | A -> T | No |
| 1613 | A -> | No |
| 1613 | A -> C | No |
| 1631 | C -> T | Yes |
| 1649 | C -> | No |
| 1649 | C -> G | No |
| 1694 | T -> G | No |
| 1705 | A -> C | Yes |

Variant protein R38144_PEA_2_P19 (SEQ ID NO:1406) according to the present invention has an amino acid sequence as given at the end of the application; it is encoded by transcript(s) R38144_PEA_2_T19 (SEQ ID NO:139). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison Report Between R38144_PEA_2_P19 (SEQ ID NO:1406) and CT31_HUMAN (SEQ ID NO:1459):

1. An isolated chimeric polypeptide encoding for R38144_PEA_2_P19 (SEQ ID NO:1406), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIRVVGGLLSAHLLSKKAGVEVEAGWPC-SGPLLRMAEEAARKLLPAFQTPTGMPYGTV NLLH-GVNPGETPVTCTAGIGTFIVEFATLSS-LTGDPVFEDVARVALMRLWESRSDIGLV GNHIDVLTGKWVAQDAGIGAGVDSYFEY-LVKGAILLQDKKLMAMFLEYNKAIRNYTR FDDW-YLWVQMYKGTVSMPVFQSLEAYWPGLQS-LIGDIDNAMRTFLNYYTVWKQFGG LPEFYNIPQGYTVEKREGYPLRPELIE-SAMYLYRATGDPTLLELGRDAVESIEKISKVEC GFAT corresponding to amino acids 1-412 of CT31_HUMAN (SEQ ID NO:1459), which also corresponds to amino acids 1-412 of R38144_PEA_2_P19 (SEQ ID NO:1406), and a second amino acid sequence being at least 70%, optionally at least 80%, preferably at least 85%, more preferably at least 90% and most preferably at least 95% homologous to a polypeptide having the sequence KRSRSVA-QAGVQWCDHDSPQP (SEQ ID NO: 270) corresponding to amino acids 413-433 of R38144_PEA_2_P19 (SEQ ID NO:1406), wherein said first amino acid sequence and second amino acid sequence are contiguous and in a sequential order.

2. An isolated polypeptide encoding for a tail of R38144_PEA_2_P19 (SEQ ID NO:1406), comprising a polypeptide being at least 70%, optionally at least about 80%, preferably at least about 85%, more preferably at least about 90% and most preferably at least about 95% homologous to the sequence KRSRSVAQAGVQWCDHDSPQP (SEQ ID NO: 270) in R38144_PEA_2_P19 (SEQ ID NO:1406).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P19 (SEQ ID NO:1406) also has the following non-silent SNPs (Single Nucleotide Polymorphisms) as listed in Table 1184, (given according to their position(s) on the amino acid sequence, with the alternative amino acid(s) listed; the last column indicates whether the SNP is known or not; the presence of known SNPs in variant protein R38144_PEA_2_P19 (SEQ ID NO:1406) sequence provides support for the deduced sequence of this variant protein according to the present invention).

TABLE 1184

Amino acid mutations

| SNP position(s) on amino acid sequence | Alternative amino acid(s) | Previously known SNP? |
|---|---|---|
| 10 | G -> | No |
| 54 | A -> V | Yes |
| 55 | F -> L | Yes |
| 73 | S -> I | Yes |
| 87 | I -> | No |
| 145 | P -> | No |
| 145 | P -> A | No |
| 164 | A -> G | No |
| 164 | A -> | No |
| 203 | A -> G | No |
| 203 | A -> | No |
| 211 | D -> | No |
| 236 | G -> | No |
| 265 | V -> G | No |
| 285 | K -> | No |
| 294 | D -> N | No |
| 305 | G -> E | No |
| 323 | Q -> R | No |
| 346 | F -> | No |

The glycosylation sites of variant protein R38144_PEA_2_P19 (SEQ ID NO:1406), as compared to the known protein Putative alpha-mannosidase C20orf31 precursor (SEQ ID NO:1459), are described in Table 1185 (given according to their position(s) on the amino acid sequence in the first column; the second column indicates whether the glycosylation site is present in the variant protein; and the last column indicates whether the position is different on the variant protein).

TABLE 1185

| Glycosylation site(s) | | |
|---|---|---|
| Position(s) on known amino acid sequence | Present in variant protein? | Position in variant protein? |
| 450 | no | |
| 289 | yes | 289 |
| 112 | yes | 112 |
| 90 | yes | 90 |

Variant protein R38144_PEA_2_P19 (SEQ ID NO:1406) is encoded by the following transcript(s): R38144_PEA_2_T19 (SEQ ID NO:139), for which the sequence(s) is/are given at the end of the application. The coding portion of transcript R38144_PEA_2_T19 (SEQ ID NO:139) is shown in bold; this coding portion starts at position 91 and ends at position 1389. The transcript also has the following SNPs as listed in Table 1186 (given according to their position on the nucleotide sequence, with the alternative nucleic acid listed; the last column indicates whether the SNP is known or not; the presence of known SNPs in variant protein R38144_PEA_2_P19 (SEQ ID NO:1406) sequence provides support for the deduced sequence of this variant protein according to the present invention).

TABLE 1186

Nucleic acid SNPs

| SNP position on nucleotide sequence | Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 943 | A -> | No |
| 970 | G -> A | No |
| 1004 | G -> A | No |
| 1058 | A -> G | No |
| 1126 | T -> | No |
| 1218 | C -> T | Yes |
| 1446 | C -> | Yes |

Variant protein R38144_PEA_2_P24 (SEQ ID NO:1407) according to the present invention has an amino acid sequence as given at the end of the application; it is encoded by transcript(s) R38144_PEA_2_T27 (SEQ ID NO:140). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison Report Between R38144_PEA_2_P24 (SEQ ID NO:1407) and CT31_HUMAN (SEQ ID NO:1459):

1. An isolated chimeric polypeptide encoding for R38144_PEA_2_P24 (SEQ ID NO:1407), comprising a first amino acid sequence being at least 90% homologous to MPFRLLIPLGLLCALLPQHHGAPGPDG-SAPDPAHYRERVKAMFYHAYDSYLENAFPFD ELR-PLTCDGHDTWGSFSLTLIDALDTL-LILGNVSEFQRVVEVLQDSVDFDIDVNASVFET NIR corresponding to amino acids 1-121 of CT31_HUMAN (SEQ ID NO:1459), which also corresponds to amino acids 1-121 of R38144_PEA_2_P24 (SEQ ID NO:1407), and a second amino acid sequence being at least 90% homologous to EYNKAIRNYTRFDDWYL-WVQMYKGTVSMPVFQSLEAYWPGLQS-LIGDIDNAMRTFLN YYTVWKQFGGLPE-FYNIPQGYTVEKREGYPLRPELIESAMYLYRATGD PTLLELGRDA VESIEKISKVECGFATIKDLRDHKLDN-RMESFFLAETVKYLYLLFDPTNFIHNNGSTFDA VIT-PYGECILGAGGYIFNTEAHPIDPAALHC-CQRLKEEQWEVEDLMREFYSLKRSRSKFQ KNTVSSGPWEPPARPGTLFSPEN-HDQARERKPAKQKVPLLSCPSQPFTSKLALLGQVFL DSS corresponding to amino acids 282-578 of CT31_HUMAN (SEQ ID NO:1459), which also corresponds to amino acids 122-418 of R38144_PEA_2_P24 (SEQ ID NO:1407), wherein said first amino acid sequence and second amino acid sequence are contiguous and in a sequential order.

2. An isolated chimeric polypeptide encoding for an edge portion of R38144_PEA_2_P24 (SEQ ID NO:1407), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RE, having a structure as follows: a sequence starting from any of amino acid numbers 121−x to 121; and ending at any of amino acid numbers 122+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P24 (SEQ ID NO:1407) also has the following non-silent SNPs (Single Nucleotide Polymorphisms) as listed in Table 1187, (given according to their position(s) on the amino acid sequence, with the alternative amino acid(s) listed; the last column indicates whether the SNP is known or not; the presence of known SNPs in variant protein R38144_PEA_2_P24 (SEQ ID NO:1407) sequence provides support for the deduced sequence of this variant protein according to the present invention).

TABLE 1187

| | Amino acid mutations | |
|---|---|---|
| SNP position(s) on amino acid sequence | Alternative amino acid(s) | Previously known SNP? |
| 10 | G -> | No |
| 54 | A -> V | Yes |
| 55 | F -> L | Yes |
| 73 | S -> I | Yes |
| 87 | I -> | No |
| 125 | K -> | No |
| 134 | D -> N | No |
| 145 | G -> E | No |
| 163 | Q -> R | No |
| 186 | F -> | No |
| 266 | E -> G | No |
| 277 | L -> P | No |
| 296 | A -> T | Yes |
| 322 | P -> L | No |
| 324 | A -> | No |
| 350 | R -> Q | Yes |
| 351 | S -> C | No |
| 390 | K -> | No |
| 390 | K -> Q | No |
| 396 | L -> F | Yes |
| 402 | P -> | No |
| 402 | P -> A | No |
| 417 | S -> A | No |

The glycosylation sites of variant protein R38144_PEA_2_P24 (SEQ ID NO:1407), as compared to the known protein Putative alpha-mannosidase C20orf31 precursor (SEQ ID NO:1459), are described in Table 1188 (given according to their position(s) on the amino acid sequence in the first column; the second column indicates whether the glycosylation site is present in the variant protein; and the last column indicates whether the position is different on the variant protein).

TABLE 1188

| | Glycosylation site(s) | |
|---|---|---|
| Position(s) on known amino acid sequence | Present in variant protein? | Position in variant protein? |
| 450 | yes | 290 |
| 289 | yes | 129 |
| 112 | yes | 112 |
| 90 | yes | 90 |

Variant protein R38144_PEA_2_P24 (SEQ ID NO:1407) is encoded by the following transcript(s): R38144_PEA_2_T27 (SEQ ID NO:140), for which the sequence(s) is/are given at the end of the application. The coding portion of transcript R38144_PEA_2_T27 (SEQ ID NO:140) is shown in bold; this coding portion starts at position 91 and ends at position 1344. The transcript also has the following SNPs as listed in Table 1189 (given according to their position on the nucleotide sequence, with the alternative nucleic acid listed; the last column indicates whether the SNP is known or not; the presence of known SNPs in variant protein R38144_PEA_2_P24 (SEQ ID NO:1407) sequence provides support for the deduced sequence of this variant protein according to the present invention).

TABLE 1189

Nucleic acid SNPs

| SNP position on nucleotide sequence | Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 463 | A -> | No |
| 490 | G -> A | No |
| 524 | G -> A | No |
| 578 | A -> G | No |
| 646 | T -> | No |
| 738 | C -> T | Yes |
| 887 | A -> G | No |
| 920 | T -> C | No |
| 976 | G -> A | Yes |
| 1055 | C -> T | No |
| 1061 | C -> | No |
| 1139 | G -> A | Yes |
| 1141 | A -> T | No |
| 1258 | A -> | No |
| 1258 | A -> C | No |
| 1276 | C -> T | Yes |
| 1294 | C -> | No |
| 1294 | C -> G | No |
| 1339 | T -> G | No |
| 1350 | A -> C | Yes |

Variant protein R38144_PEA_2_P36 (SEQ ID NO:1408) according to the present invention has an amino acid sequence as given at the end of the application; it is encoded by transcript(s) R38144_PEA_2_T10 (SEQ ID NO:136). An alignment is given to the known protein (Putative alpha-mannosidase C20orf31 precursor (SEQ ID NO:1459); SEQ ID NO:1459) at the end of the application. One or more alignments to one or more previously published protein sequences are given at the end of the application. A brief description of the relationship of the variant protein according to the present invention to each such aligned protein is as follows:

Comparison Report Between R38144_PEA_2_P36 (SEQ ID NO:1408) and AAH16184 (SEQ ID NO: 1460):

1. An isolated chimeric polypeptide encoding for R38144_PEA_2_P36 (SEQ ID NO:1408), comprising a first amino acid sequence being at least 90% homologous to MPFRLLIPLGLLCALLPQHHGAPGPDGSAPDPAHYR corresponding to amino acids 1-36 of AAH16184 (SEQ ID NO:1460), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGMSQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

2. An isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWTLILM (SEQ ID NO: 272) in R38144_PEA_2_P36 (SEQ ID NO:1408).

Comparison Report Between R38144_PEA_2_P36 (SEQ ID NO:1408) and AAQ88943 (SEQ ID NO:1461):

1. An isolated chimeric polypeptide encoding for R38144_PEA_2_P36 (SEQ ID NO:1408), comprising a first amino acid sequence being at least 90% homologous to MPFRLLIPLGLLCALLPQHHGAPGPDGSAPDPAHY corresponding to amino acids 1-35 of AAQ88943 (SEQ ID NO:1461), which also corresponds to amino acids 1-35 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence RFWGMSQNSKEWLKCSRTAWTLILM corresponding to amino acids 36-60 of R38144_PEA_2_P36 (SEQ ID NO:1408), wherein said first amino acid sequence and second amino acid sequence are contiguous and in a sequential order.

2. An isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence RFWGMSQNSKEWLKCSRTAWTLILM in R38144_PEA_2_P36 (SEQ ID NO:1408).

Comparison Report Between R38144_PEA_2_P36 (SEQ ID NO:1408) and CT31_HUMAN (SEQ ID NO:1459):

1. An isolated chimeric polypeptide encoding for R38144_PEA_2_P36 (SEQ ID NO:1408), comprising a first amino acid sequence being at least 90% homologous to MPFRLLIPLGLLCALLPQHHGAPGPDGSAPDPAHYR corresponding to amino acids 1-36 of CT31_HUMAN (SEQ ID NO:1459), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGMSQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

2. An isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWTLILM (SEQ ID NO: 272) in R38144_PEA_2_P36 (SEQ ID NO:1408).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P36 (SEQ ID NO:1408) also has the following non-silent SNPs (Single Nucleotide Polymorphisms) as listed in Table 1190, (given according to their position(s) on the amino acid sequence, with the alternative amino acid(s) listed; the last column indicates whether the SNP is known or not; the presence of known SNPs in variant protein R38144_PEA_2_P36 (SEQ ID NO:1408) sequence provides support for the deduced sequence of this variant protein according to the present invention).

TABLE 1190

| Amino acid mutations | | |
|---|---|---|
| SNP position(s) on amino acid sequence | Alternative amino acid(s) | Previously known SNP? |
| 10 | G -> | No |
| 37 | F -> | No |

The glycosylation sites of variant protein R38144_PEA_2_P36 (SEQ ID NO:1408), as compared to the known protein Putative alpha-mannosidase C20orf31 precursor (SEQ ID NO:1459), are described in Table 1191 (given according to their position(s) on the amino acid sequence in the first column; the second column indicates whether the glycosylation site is present in the variant protein; and the last column indicates whether the position is different on the variant protein).

TABLE 1191

| Glycosylation site(s) | |
|---|---|
| Position(s) on known amino acid sequence | Present in variant protein? |
| 450 | no |
| 289 | no |
| 112 | no |
| 90 | no |

Variant protein R38144_PEA_2_P36 (SEQ ID NO:1408) is encoded by the following transcript(s): R38144_PEA_2_T10 (SEQ ID NO:136), for which the sequence(s) is/are given at the end of the application. The coding portion of transcript R38144_PEA_2_T10 (SEQ ID NO:136) is shown in bold; this coding portion starts at position 91 and ends at position 270. The transcript also has the following SNPs as listed in Table 1192 (given according to their position on the nucleotide sequence, with the alternative nucleic acid listed; the last column indicates whether the SNP is known or not; the presence of known SNPs in variant protein R38144_PEA_2_P36 (SEQ ID NO:1408) sequence provides support for the deduced sequence of this variant protein according to the present invention).

TABLE 1192

| Nucleic acid SNPs | | |
|---|---|---|
| SNP position on nucleotide sequence | Alternative nucleic acid | Previously known SNP? |
| 120 | C -> | No |
| 199 | T -> | No |
| 372 | C -> | No |
| 372 | C -> G | No |
| 430 | C -> | No |
| 430 | C -> G | No |
| 547 | C -> | No |
| 547 | C -> G | No |
| 572 | C -> | No |
| 647 | C -> | No |
| 647 | C -> G | No |
| 698 | -> C | No |
| 698 | -> G | No |
| 733 | T -> G | No |
| 750 | -> C | No |
| 750 | -> T | No |
| 792 | A -> | No |
| 819 | G -> A | No |

TABLE 1192-continued

| Nucleic acid SNPs | | |
|---|---|---|
| SNP position on nucleotide sequence | Alternative nucleic acid | Previously known SNP? |
| 853 | G -> A | No |
| 907 | A -> G | No |
| 975 | T -> | No |
| 1067 | C -> T | Yes |
| 1216 | A -> G | No |
| 1249 | T -> C | No |
| 1305 | G -> A | Yes |
| 1384 | C -> T | No |
| 1390 | C -> | No |
| 1468 | G -> A | Yes |
| 1470 | A -> T | No |
| 1587 | A -> | No |
| 1587 | A -> C | No |
| 1605 | C -> T | Yes |
| 1623 | C -> | No |
| 1623 | C -> G | No |
| 1668 | T -> G | No |
| 1679 | A -> C | Yes |

As noted above, cluster R38144 features 24 segment(s), which were listed in Table 2 above and for which the sequence (s)are given at the end of the application. These segment(s) are portions of nucleic acid sequence(s) which are described herein separately because they are of particular interest. A description of each segment according to the present invention is now provided.

Segment cluster R38144_PEA_2_node_21 (SEQ ID NO:937) according to the present invention is supported by 108 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1193 below describes the starting and ending position of this segment on each transcript.

TABLE 1193

| Segment location on transcripts | | |
|---|---|---|
| Transcript name | Segment starting position | Segment ending position |
| R38144_PEA_2_T6 (SEQ ID NO: 135) | 626 | 792 |
| R38144_PEA_2_T10 (SEQ ID NO: 136) | 475 | 641 |
| R38144_PEA_2_T13 (SEQ ID NO: 137) | 626 | 792 |
| R38144_PEA_2_T15 (SEQ ID NO: 138) | 626 | 792 |
| R38144_PEA_2_T19 (SEQ ID NO: 139) | 626 | 792 |

Segment cluster R38144_PEA_2_node_26 (SEQ ID NO:938) according to the present invention is supported by 98 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1194 below describes the starting and ending position of this segment on each transcript.

TABLE 1194

Segment location on transcripts

| Transcript name | Segment starting position | Segment ending position |
|---|---|---|
| R38144_PEA_2_T6 (SEQ ID NO: 135) | 793 | 934 |
| R38144_PEA_2_T10 (SEQ ID NO: 136) | 642 | 783 |
| R38144_PEA_2_T13 (SEQ ID NO: 137) | 793 | 934 |
| R38144_PEA_2_T15 (SEQ ID NO: 138) | 793 | 934 |
| R38144_PEA_2_T19 (SEQ ID NO: 139) | 793 | 934 |

Segment cluster R38144_PEA_2_node_29 (SEQ ID NO:939) according to the present invention is supported by 98 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T19 (SEQ ID NO:139) and R38144_PEA_2_T27 (SEQ ID NO:140). Table 1195 below describes the starting and ending position of this segment on each transcript.

TABLE 1195

Segment location on transcripts

| Transcript name | Segment starting position | Segment ending position |
|---|---|---|
| R38144_PEA_2_T6 (SEQ ID NO: 135) | 935 | 1059 |
| R38144_PEA_2_T10 (SEQ ID NO: 136) | 784 | 908 |
| R38144_PEA_2_T13 (SEQ ID NO: 137) | 935 | 1059 |
| R38144_PEA_2_T19 (SEQ ID NO: 139) | 935 | 1059 |
| R38144_PEA_2_T27 (SEQ ID NO: 140) | 455 | 579 |

Segment cluster R38144_PEA_2_node_31 (SEQ ID NO:940) according to the present invention is supported by 95 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T15 (SEQ ID NO:138), R38144_PEA_2_T19 (SEQ ID NO:139) and R38144_PEA_2_T27 (SEQ ID NO:140). Table 1196 below describes the starting and ending position of this segment on each transcript.

TABLE 1196

Segment location on transcripts

| Transcript name | Segment starting position | Segment ending position |
|---|---|---|
| R38144_PEA_2_T6 (SEQ ID NO: 135) | 1060 | 1204 |
| R38144_PEA_2_T10 (SEQ ID NO: 136) | 909 | 1053 |
| R38144_PEA_2_T15 (SEQ ID NO: 138) | 935 | 1079 |
| R38144_PEA_2_T19 (SEQ ID NO: 139) | 1060 | 1204 |
| R38144_PEA_2_T27 (SEQ ID NO: 140) | 580 | 724 |

Segment cluster R38144_PEA_2_node_46 (SEQ ID NO:941) according to the present invention is supported by 147 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T27 (SEQ ID NO:140). Table 1197 below describes the starting and ending position of this segment on each transcript.

TABLE 1197

Segment location on transcripts

| Transcript name | Segment starting position | Segment ending position |
|---|---|---|
| R38144_PEA_2_T6 (SEQ ID NO: 135) | 1373 | 1544 |
| R38144_PEA_2_T10 (SEQ ID NO: 136) | 1197 | 1368 |
| R38144_PEA_2_T13 (SEQ ID NO: 137) | 1203 | 1374 |
| R38144_PEA_2_T15 (SEQ ID NO: 138) | 1223 | 1394 |
| R38144_PEA_2_T27 (SEQ ID NO: 140) | 868 | 1039 |

Segment cluster R38144_PEA_2_node_47 (SEQ ID NO:942) according to the present invention is supported by 147 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T27 (SEQ ID NO:140). Table 1198 below describes the starting and ending position of this segment on each transcript.

TABLE 1198

Segment location on transcripts

| Transcript name | Segment starting position | Segment ending position |
|---|---|---|
| R38144_PEA_2_T6 (SEQ ID NO: 135) | 1545 | 1919 |
| R38144_PEA_2_T10 (SEQ ID NO: 136) | 1369 | 1743 |
| R38144_PEA_2_T13 (SEQ ID NO: 137) | 1375 | 1749 |
| R38144_PEA_2_T15 (SEQ ID NO: 138) | 1395 | 1769 |
| R38144_PEA_2_T27 (SEQ ID NO: 140) | 1040 | 1414 |

Segment cluster R38144_PEA_2_node_49 (SEQ ID NO:943) according to the present invention is supported by 1 libraries. The number of libraries was determined as previously described. This segment can be found in the following transcript(s): R38144_PEA_2_T19 (SEQ ID NO:139). Table 1199 below describes the starting and ending position of this segment on each transcript.

TABLE 1199

Segment location on transcripts

| Transcript name | Segment starting position | Segment ending position |
|---|---|---|
| R38144_PEA_2_T19 (SEQ ID NO: 139) | 1327 | 1448 |

According to an optional embodiment of the present invention, short segments related to the above cluster are also provided. These segments are up to about 120 bp in length, and so are included in a separate description.

Segment cluster R38144_PEA_2_node_0 (SEQ ID NO:944) according to the present invention is supported by 101 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1200 below describes the starting and ending position of this segment on each transcript.

TABLE 1201

Segment location on transcripts

| Transcript name | Segment starting position | Segment ending position |
|---|---|---|
| R38144_PEA_2_T6 (SEQ ID NO: 135) | 1 | 105 |
| R38144_PEA_2_T10 (SEQ ID NO: 136) | 1 | 105 |
| R38144_PEA_2_T13 (SEQ ID NO: 137) | 1 | 105 |
| R38144_PEA_2_T15 (SEQ ID NO: 138) | 1 | 105 |
| R38144_PEA_2_T19 (SEQ ID NO: 139) | 1 | 105 |
| R38144_PEA_2_T27 (SEQ ID NO: 140) | 1 | 105 |

Segment cluster R38144_PEA_2_node_1 (SEQ ID NO:945) according to the present invention is supported by 105 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1202 below describes the starting and ending position of this segment on each transcript.

TABLE 1202

Segment location on transcripts

| Transcript name | Segment starting position | Segment ending position |
|---|---|---|
| R38144_PEA_2_T6 (SEQ ID NO: 135) | 106 | 197 |

TABLE 1202-continued

Segment location on transcripts

| Transcript name | Segment starting position | Segment ending position |
|---|---|---|
| R38144_PEA_2_T10 (SEQ ID NO: 136) | 106 | 197 |
| R38144_PEA_2_T13 (SEQ ID NO: 137) | 106 | 197 |
| R38144_PEA_2_T15 (SEQ ID NO: 138) | 106 | 197 |
| R38144_PEA_2_T19 (SEQ ID NO: 139) | 106 | 197 |
| R38144_PEA_2_T27 (SEQ ID NO: 140) | 106 | 197 |

Segment cluster R38144_PEA_2_node_4 (SEQ ID NO:946) according to the present invention is supported by 107 libraries. The number of libraries was determined as previously described. This segment can be found in the following transcript(s): R38144_PEA_2_T6 (SEQ ID NO:135), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1203 below describes the starting and ending position of this segment on each transcript.

TABLE 1203

Segment location on transcripts

| Transcript name | Segment starting position | Segment ending position |
|---|---|---|
| R38144_PEA_2_T6 (SEQ ID NO: 135) | 198 | 299 |
| R38144_PEA_2_T13 (SEQ ID NO: 137) | 198 | 299 |
| R38144_PEA_2_T15 (SEQ ID NO: 138) | 198 | 299 |
| R38144_PEA_2_T19 (SEQ ID NO: 139) | 198 | 299 |
| R38144_PEA_2_T27 (SEQ ID NO: 140) | 198 | 299 |

Segment cluster R38144_PEA_2_node_5 (SEQ ID NO:947) according to the present invention can be found in the following transcript(s): R38144_PEA_2_T6 (SEQ ID NO:135), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1204 below describes the starting and ending position of this segment on each transcript.

TABLE 1204

Segment location on transcripts

| Transcript name | Segment starting position | Segment ending position |
|---|---|---|
| R38144_PEA_2_T6 (SEQ ID NO: 135) | 300 | 308 |
| R38144_PEA_2_T13 (SEQ ID NO: 137) | 300 | 308 |
| R38144_PEA_2_T15 (SEQ ID NO: 138) | 300 | 308 |
| R38144_PEA_2_T19 (SEQ ID NO: 139) | 300 | 308 |
| R38144_PEA_2_T27 (SEQ ID NO: 140) | 300 | 308 |

Segment cluster R38144_PEA_2_node_7 (SEQ ID NO:948) according to the present invention is supported by 92 libraries. The number of libraries was determined as previously described. This segment can be found in the following transcript(s): R38144_PEA_2_T6 (SEQ ID NO:135), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1205 below describes the starting and ending position of this segment on each transcript.

TABLE 1205

Segment location on transcripts

| Transcript name | Segment starting position | Segment ending position |
|---|---|---|
| R38144_PEA_2_T6 (SEQ ID NO: 135) | 309 | 348 |
| R38144_PEA_2_T13 (SEQ ID NO: 137) | 309 | 348 |
| R38144_PEA_2_T15 (SEQ ID NO: 138) | 309 | 348 |
| R38144_PEA_2_T19 (SEQ ID NO: 139) | 309 | 348 |
| R38144_PEA_2_T27 (SEQ ID NO: 140) | 309 | 348 |

Segment cluster R38144_PEA_2_node_11 (SEQ ID NO:949) according to the present invention is supported by 106 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1206 below describes the starting and ending position of this segment on each transcript.

TABLE 1206

Segment location on transcripts

| Transcript name | Segment starting position | Segment ending position |
|---|---|---|
| R38144_PEA_2_T6 (SEQ ID NO: 135) | 349 | 454 |
| R38144_PEA_2_T10 (SEQ ID NO: 136) | 198 | 303 |
| R38144_PEA_2_T13 (SEQ ID NO: 137) | 349 | 454 |
| R38144_PEA_2_T15 (SEQ ID NO: 138) | 349 | 454 |
| R38144_PEA_2_T19 (SEQ ID NO: 139) | 349 | 454 |
| R38144_PEA_2_T27 (SEQ ID NO: 140) | 349 | 454 |

Segment cluster R38144_PEA_2_node_14 (SEQ ID NO:950) according to the present invention can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1207 below describes the starting and ending position of this segment on each transcript.

TABLE 1207

Segment location on transcripts

| Transcript name | Segment starting position | Segment ending position |
|---|---|---|
| R38144_PEA_2_T6 (SEQ ID NO: 135) | 455 | 460 |
| R38144_PEA_2_T10 (SEQ ID NO: 136) | 304 | 309 |
| R38144_PEA_2_T13 (SEQ ID NO: 137) | 455 | 460 |
| R38144_PEA_2_T15 (SEQ ID NO: 138) | 455 | 460 |
| R38144_PEA_2_T19 (SEQ ID NO: 139) | 455 | 460 |

Segment cluster R38144_PEA_2_node_15 (SEQ ID NO:951) according to the present invention is supported by 105 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1208 below describes the starting and ending position of this segment on each transcript.

TABLE 1208

Segment location on transcripts

| Transcript name | Segment starting position | Segment ending position |
|---|---|---|
| R38144_PEA_2_T6 (SEQ ID NO: 135) | 461 | 487 |
| R38144_PEA_2_T10 (SEQ ID NO: 136) | 310 | 336 |
| R38144_PEA_2_T13 (SEQ ID NO: 137) | 461 | 487 |
| R38144_PEA_2_T15 (SEQ ID NO: 138) | 461 | 487 |
| R38144_PEA_2_T19 (SEQ ID NO: 139) | 461 | 487 |

Segment cluster R38144_PEA_2_node_16 (SEQ ID NO:952) according to the present invention is supported by 106 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1209 below describes the starting and ending position of this segment on each transcript.

TABLE 1209

Segment location on transcripts

| Transcript name | Segment starting position | Segment ending position |
|---|---|---|
| R38144_PEA_2_T6 (SEQ ID NO: 135) | 488 | 580 |
| R38144_PEA_2_T10 (SEQ ID NO: 136) | 337 | 429 |
| R38144_PEA_2_T13 (SEQ ID NO: 137) | 488 | 580 |
| R38144_PEA_2_T15 (SEQ ID NO: 138) | 488 | 580 |

TABLE 1209-continued

Segment location on transcripts

| Transcript name | Segment starting position | Segment ending position |
|---|---|---|
| R38144_PEA_2_T19 (SEQ ID NO: 139) | 488 | 580 |

Segment cluster R38144_PEA_2_node_19 (SEQ ID NO:953) according to the present invention is supported by 93 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1210 below describes the starting and ending position of this segment on each transcript.

TABLE 1210

Segment location on transcripts

| Transcript name | Segment starting position | Segment ending position |
|---|---|---|
| R38144_PEA_2_T6 (SEQ ID NO: 135) | 581 | 615 |
| R38144_PEA_2_T10 (SEQ ID NO: 136) | 430 | 464 |
| R38144_PEA_2_T13 (SEQ ID NO: 137) | 581 | 615 |
| R38144_PEA_2_T15 (SEQ ID NO: 138) | 581 | 615 |
| R38144_PEA_2_T19 (SEQ ID NO: 139) | 581 | 615 |

Segment cluster R38144_PEA_2_node_20 (SEQ ID NO:954) according to the present invention can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1211 below describes the starting and ending position of this segment on each transcript.

TABLE 1211

Segment location on transcripts

| Transcript name | Segment starting position | Segment ending position |
|---|---|---|
| R38144_PEA_2_T6 (SEQ ID NO: 135) | 616 | 625 |
| R38144_PEA_2_T10 (SEQ ID NO: 136) | 465 | 474 |
| R38144_PEA_2_T13 (SEQ ID NO: 137) | 616 | 625 |
| R38144_PEA_2_T15 (SEQ ID NO: 138) | 616 | 625 |
| R38144_PEA_2_T19 (SEQ ID NO: 139) | 616 | 625 |

Segment cluster R38144_PEA_2_node_36 (SEQ ID NO:955) according to the present invention is supported by 95 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1212 below describes the starting and ending position of this segment on each transcript.

TABLE 1212

Segment location on transcripts

| Transcript name | Segment starting position | Segment ending position |
|---|---|---|
| R38144_PEA_2_T6 (SEQ ID NO: 135) | 1205 | 1293 |
| R38144_PEA_2_T10 (SEQ ID NO: 136) | 1054 | 1142 |
| R38144_PEA_2_T13 (SEQ ID NO: 137) | 1060 | 1148 |
| R38144_PEA_2_T15 (SEQ ID NO: 138) | 1080 | 1168 |
| R38144_PEA_2_T19 (SEQ ID NO: 139) | 1205 | 1293 |
| R38144_PEA_2_T27 (SEQ ID NO: 140) | 725 | 813 |

Segment cluster R38144_PEA_2_node_37 (SEQ ID NO:956) according to the present invention is supported by 97 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1213 below describes the starting and ending position of this segment on each transcript.

TABLE 1213

Segment location on transcripts

| Transcript name | Segment starting position | Segment ending position |
|---|---|---|
| R38144_PEA_2_T6 (SEQ ID NO: 135) | 1294 | 1326 |
| R38144_PEA_2_T10 (SEQ ID NO: 136) | 1143 | 1175 |
| R38144_PEA_2_T13 (SEQ ID NO: 137) | 1149 | 1181 |
| R38144_PEA_2_T15 (SEQ ID NO: 138) | 1169 | 1201 |
| R38144_PEA_2_T19 (SEQ ID NO: 139) | 1294 | 1326 |
| R38144_PEA_2_T27 (SEQ ID NO: 140) | 814 | 846 |

Segment cluster R38144_PEA_2_node_43 (SEQ ID NO:957) according to the present invention can be found in the following transcript(s): R38144_PEA_2_T6 (SEQ ID NO:135). Table 1214 below describes the starting and ending position of this segment on each transcript.

TABLE 1214

Segment location on transcripts

| Transcript name | Segment starting position | Segment ending position |
|---|---|---|
| R38144_PEA_2_T6 (SEQ ID NO: 135) | 1327 | 1346 |

Segment cluster R38144_PEA_2_node_44 (SEQ ID NO:958) according to the present invention can be found in the following transcript(s): R38144_PEA_2_T6 (SEQ ID NO:135). Table 1215 below describes the starting and ending position of this segment on each transcript.

TABLE 1215

Segment location on transcripts

| Transcript name | Segment starting position | Segment ending position |
|---|---|---|
| R38144_PEA_2_T6 (SEQ ID NO: 135) | 1347 | 1351 |

Segment cluster R38144_PEA_2_node_45 (SEQ ID NO:959) according to the present invention can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T27 (SEQ ID NO:140). Table 1216 below describes the starting and ending position of this segment on each transcript.

TABLE 1216

Segment location on transcripts

| Transcript name | Segment starting position | Segment ending position |
|---|---|---|
| R38144_PEA_2_T6 (SEQ ID NO: 135) | 1352 | 1372 |
| R38144_PEA_2_T10 (SEQ ID NO: 136) | 1176 | 1196 |
| R38144_PEA_2_T13 (SEQ ID NO: 137) | 1182 | 1202 |
| R38144_PEA_2_T15 (SEQ ID NO: 138) | 1202 | 1222 |
| R38144_PEA_2_T27 (SEQ ID NO: 140) | 847 | 867 |

Segment cluster R38144_PEA_2_node_51 (SEQ ID NO:960) according to the present invention is supported by 1 libraries. The number of libraries was determined as previously described. This segment can be found in the following transcript(s): R38144_PEA_2_T19 (SEQ ID NO:139). Table 1217 below describes the starting and ending position of this segment on each transcript.

TABLE 1217

Segment location on transcripts

| Transcript name | Segment starting position | Segment ending position |
|---|---|---|
| R38144_PEA_2_T19 (SEQ ID NO: 139) | 1449 | 1522 |

Variant Protein Alignment to the Previously Known Protein:

Sequence name: CT31_HUMAN (SEQ ID NO:1459)

Sequence documentation:

Alignment of: R38144_PEA_2_P6 (SEQ ID NO:1403) x CT31_HUMAN (SEQ ID NO:1459) ..

Alignment segment 1/1:

| | | | |
|---|---|---|---|
| Quality: | 4031.00 | Escore: | 0 |
| Matching length: | 413 | Total length: | 413 |
| Matching Percent Similarity: | 100.00 | Matching Percent Identity: | 99.76 |
| Total Percent Similarity: | 100.00 | Total Percent Identity: | 99.76 |
| Gaps: | 0 | | |

Alignment:

```
  1  MPFRLLIPLGLLCALLPQHHGAPGPDGSAPDPAHYRERVKAMFYHAYDSY   50
     ||||||||||||||||||||||||||||||||||||||||||||||||||
  1  MPFRLLIPLGLLCALLPQHHGAPGPDGSAPDPAHYRERVKAMFYHAYDSY   50

51  LENAFPFDELRPLTCDGHDTWGSFSLTLIDALDTLLILGNVSEFQRVVEV  100
     ||||||||||||||||||||||||||||||||||||||||||||||||||
 51  LENAFPFDELRPLTCDGHDTWGSFSLTLIDALDTLLILGNVSEFQRVVEV  100

101  LQDSVDFDIDVNASVFETNIRVVGGLLSAHLLSKKAGVEVEAGWPCSGPL  150
     ||||||||||||||||||||||||||||||||||||||||||||||||||
101  LQDSVDFDIDVNASVFETNIRVVGGLLSAHLLSKKAGVEVEAGWPCSGPL  150

151  LRMAEEAARKLLPAFQTPTGMPYGTVNLLHGVNPGETPVTCTAGIGTFIV  200
     ||||||||||||||||||||||||||||||||||||||||||||||||||
151  LRMAEEAARKLLPAFQTPTGMPYGTVNLLHGVNPGETPVTCTAGIGTFIV  200

201  EFATLSSLTGDPVFEDVARVALMRLWESRSDIGLVGNHIDVLTGKWVAQD  250
     ||||||||||||||||||||||||||||||||||||||||||||||||||
201  EFATLSSLTGDPVFEDVARVALMRLWESRSDIGLVGNHIDVLTGKWVAQD  250

251  AGIGAGVDSYFEYLVKGAILLQDKKLMAMFLEYNKAIRNYTRFDDWYLWV  300
     ||||||||||||||||||||||||||||||||||||||||||||||||||
251  AGIGAGVDSYFEYLVKGAILLQDKKLMAMFLEYNKAIRNYTRFDDWYLWV  300

301  QMYKGTVSMPVFQSLEAYWPGLQSLIGDIDNAMRTFLNYYTVWKQFGGLP  350
     ||||||||||||||||||||||||||||||||||||||||||||||||||
301  QMYKGTVSMPVFQSLEAYWPGLQSLIGDIDNAMRTFLNYYTVWKQFGGLP  350
```

```
351  EFYNIPQGYTVEKREGYPLRPELIESAMYLYRATGDPTLLELGRDAVESI  400
     |||||||||||||||||||||||||||||||||||||||||||||||||
351  EFYNIPQGYTVEKREGYPLRPELIESAMYLYRATGDPTLLELGRDAVESI  400

401  EKISKVECGFATL                                      413
     ||||||||||||:
401  EKISKVECGFATI                                      413
```

Sequence name: CT31_HUMAN (SEQ ID NO:1459)
Sequence documentation:
Alignment of: R38144_PEA_2_P13 (SEQ ID NO:1404) x CT31_HUMAN (SEQ ID NO:1459) ..
Alignment segment 1/1:

| | | | |
|---|---|---|---|
| Quality: | 3167.00 | Escore: | 0 |
| Matching length: | 326 | Total length: | 326 |
| Matching Percent Similarity: | 100.00 | Matching Percent Identity: | 99.39 |
| Total Percent Similarity: | 100.00 | Total Percent Identity: | 99.39 |
| Gaps: | 0 | | |

Alignment:

```
1    MPFRLLIPLGLLCALLPQHHGAPGPDGSAPDPAHYRERVKAMFYHAYDSY  50
     |||||||||||||||||||||||||||||||||||||||||||||||||
1    MPFRLLIPLGLLCALLPQHHGAPGPDGSAPDPAHYRERVKAMFYHAYDSY  50

51   LENAFPFDELRPLTCDGHDTWGSFSLTLIDALDTLLILGNVSERQRVVEV  100
     |||||||||||||||||||||||||||||||||||||||||||||||||
51   LENAFPFDELRPLTCDGHDTWGSFSLTLIDALDTLLILGNVSERQRVVEV  100

101  LQDSVDFDIDVNASVFETNIRVVGGLLSAHLLSKKAGVEVEAGWPCSGPL  150
     |||||||||||||||||||||||||||||||||||||||||||||||||
101  LQDSVDFDIDVNASVFETNIRVVGGLLSAHLLSKKAGVEVEAGWPCSGPL  150

151  LRMAEEAARKLLPAFQTPTGMPYGTVNLLHGVNPGETPVTCTAGIGTFIV  200
     |||||||||||||||||||||||||||||||||||||||||||||||||
151  LRMAEEAARKLLPAFQTPTGMPYGTVNLLHGVNPGETPVTCTAGIGTFIV  200

201  EFATLSSLTGDPVFEDVARVALMRLWESRSDIGLVGNHIDVLTGKWVAQD  250
     |||||||||||||||||||||||||||||||||||||||||||||||||
201  EFATLSSLTGDPVFEDVARVALMRLWESRSDIGLVGNHIDVLTGKWVAQD  250

251  AGIGAGVDSYFEYLVKGAILLQDKKLMAMFLEYNKAIRNYTRFDDWYLWV  300
     |||||||||||||||||||||||||||||||||||||||||||||||||
251  AGIGAGVDSYFEYLVKGAILLQDKKLMAMFLEYNKAIRNYTRFDDWYLWV  300

301  QMYKGTVSMPVFQSLEAYWPGLQNLL                         326
     ||||||||||||||||||||||||:|:
301  QMYKGTVSMPVFQSLEAYWPGLQSLI                         326
```

Sequence name: CT31_HUMAN (SEQ ID NO:1459)
Sequence documentation:
Alignment of: R38144_PEA_2_P15 (SEQ ID NO:1405) x
  CT31_HUMAN (SEQ ID NO:1459) ..
Alignment segment 1/1:

| | | | |
|---|---|---|---|
| Quality: | 2725.00 | Escore: | 0 |
| Matching length: | 282 | Total length: | 282 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MPFRLLIPLGLLCALLPQHHGAPGPDGSAPDPAHYRERVKAMFYHAYDSY   50
    ||||||||||||||||||||||||||||||||||||||||||||||||||
  1 MPFRLLIPLGLLCALLPQHHGAPGPDGSAPDPAHYRERVKAMFYHAYDSY   50

51 LENAFPFDELRPLTCDGHDTWGSFSLTLIDALDTLLILGNVSEFQRVVEV  100
    ||||||||||||||||||||||||||||||||||||||||||||||||||
 51 LENAFPFDELRPLTCDGHDTWGSFSLTLIDALDTLLILGNVSEFQRVVEV  100

101 LQDSVDFDIDVNASVFETNIRVVGGLLSAHLLSKKAGVEVEAGWPCSGPL  150
    ||||||||||||||||||||||||||||||||||||||||||||||||||
101 LQDSVDFDIDVNASVFETNIRVVGGLLSAHLLSKKAGVEVEAGWPCSGPL  150

151 LRMAEEAARKLLPAFQTPTGMPYGTVNLLHGVNPGETPVTCTAGIGTFIV  200
    ||||||||||||||||||||||||||||||||||||||||||||||||||
151 LRMAEEAARKLLPAFQTPTGMPYGTVNLLHGVNPGETPVTCTAGIGTFIV  200

201 EFATLSSLTGDPVFEDVARVALMRLWESRSDIGLVGNHIDVLTGKWVAQD  250
    ||||||||||||||||||||||||||||||||||||||||||||||||||
201 EFATLSSLTGDPVFEDVARVALMRLWESRSDIGLVGNHIDVLTGKWVAQD  250

251 AGIGAGVDSYFEYLVKGAILLQDKKLMAMFLE                    282
    ||||||||||||||||||||||||||||||||
251 AGIGAGVDSYFEYLVKGAILLQDKKLMAMFLE                    282
```

Sequence name: CT31_HUMAN (SEQ ID NO:1459)

Sequence documentation:

Alignment of: R38144_PEA_2_P19 (SEQ ID NO:1406) x
  CT31_HUMAN (SEQ ID NO:1459) ..

Alignment segment 1/1:

| | | | |
|---|---|---|---|
| Quality: | 4029.00 | Escore: | 0 |
| Matching length: | 412 | Total length: | 412 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MPFRLLIPLGLLCALLPQHHGAPGPDGSAPDPAHYRERVKAMFYHAYDSY   50
    ||||||||||||||||||||||||||||||||||||||||||||||||||
  1 MPFRLLIPLGLLCALLPQHHGAPGPDGSAPDPAHYRERVKAMFYHAYDSY   50

51 LENAFPFDELRPLTCDGHDTWGSFSLTLIDALDTLLILGNVSEFQRVVEV  100
    ||||||||||||||||||||||||||||||||||||||||||||||||||
 51 LENAFPFDELRPLTCDGHDTWGSFSLTLIDALDTLLILGNVSEFQRVVEV  100

101 LQDSVDFDIDVNASVFETNIRVVGGLLSAHLLSKKAGVEVEAGWPCSGPL  150
    ||||||||||||||||||||||||||||||||||||||||||||||||||
101 LQDSVDFDIDVNASVFETNIRVVGGLLSAHLLSKKAGVEVEAGWPCSGPL  150

151 LRMAEEAARKLLPAFQTPTGMPYGTVNLLHGVNPGETPVTCTAGIGTFIV  200
    ||||||||||||||||||||||||||||||||||||||||||||||||||
151 LRMAEEAARKLLPAFQTPTGMPYGTVNLLHGVNPGETPVTCTAGIGTFIV  200
```

-continued

```
201  EFATLSSLTGDPVFEDVARVALMRLWESRSDIGLVGNHIDVLTGKWVAQD  250
     ||||||||||||||||||||||||||||||||||||||||||||||||||
201  EFATLSSLTGDPVFEDVARVALMRLWESRSDIGLVGNHIDVLTGKWVAQD  250

251  AGIGAGVDSYFEYLVKGAILLQDKKLMAMFLEYNKAIRNYTRFDDWYLWV  300
     |||||||||||||||||||||||||||||||||||||||||||||||||
251  AGIGAGVDSYFEYLVKGAILLQDKKLMAMFLEYNKAIRNYTRFDDWYLWV  300

301  QMYKGTVSMPVFQSLEAYWPGLQSLIGDIDNAMRTFLNYYTVWKQFGGLP  350
     |||||||||||||||||||||||||||||||||||||||||||||||||
301  QMYKGTVSMPVFQSLEAYWPGLQSLIGDIDNAMRTFLNYYTVWKQFGGLP  350

351  EFYNIPQGYTVEKREGYPLRPELIESAMYLYRATGDPTLLELGRDAVESI  400
     |||||||||||||||||||||||||||||||||||||||||||||||||
351  EFYNIPQGYTVEKREGYPLRPELIESAMYLYRATGDPTLLELGRDAVESI  400

401  EKISKVECGFAT  412
     ||||||||||||
401  EKISKVECGFAT  412
```

Sequence name: CT31_HUMAN (SEQ ID NO:1459)

Sequence documentation:

Alignment of: R38144_PEA_2_P24 (SEQ ID NO:1407) x CT31_HUMAN (SEQ ID NO:1459) ..

Alignment segment 1/1:

| | | | |
|---|---|---|---|
| Quality: | 4063.00 | Escore: | 0 |
| Matching length: | 418 | Total length: | 578 |
| Matching Percent Similarity: | 100.00 | Matching Percent Identity: | 100.00 |
| Total Percent Similarity: | 72.32 | Total Percent Identity: | 72.32 |
| Gaps: | 1 | | |

Alignment:

```
  1  MPFRLLIPLGLLCALLPQHHGAPGPDGSAPDPAHYRERVKAMFYHAYDSY   50
     ||||||||||||||||||||||||||||||||||||||||||||||||||
  1  MPFRLLIPLGLLCALLPQHHGAPGPDGSAPDPAHYRERVKAMFYHAYDSY   50

51  LENAFPPFDELRPLTCDGHDTWGSFSLTLIDALDTLLILGNVSEFQRVVEV  100
     ||||||||||||||||||||||||||||||||||||||||||||||||||
 51  LENAFPPFDELRPLTCDGHDTWGSFSLTLIDALDTLLILGNVSEFQRVVEV  100

101  LQDSVDFDIDVNASVFETNIR.............................  121
     |||||||||||||||||||||
101  LQDSVDFDIDVNASVFETNIRVVGGLLSAHLLSKKAGVEVEAGWPCSGPL  150

121  ..................................................  121

151  LRMAEEAARKLLPAFQTPTGMPYGTVNLLHGVNPGETPVTCTAGIGTFIV  200

121  ..................................................  121

201  EFATLSSLTGDPVFEDVARVALMRLWESRSDIGLVGNHIDVLTGKWVAQD  250

122  ...............................EYNKAIRNYTRFDDWYLWV  140
                                    ||||||||||||||||||||
251  AGIGAGVDSYFEYLVKGAILLQDKKLMAMFLEYNKAIRNYTRFDDWYLWV  300

141  QMYKGTVSMPVFQSLEAYWPGLQSLIGDIDNAMRTFLNYYTVWKQFGGLP  190
     ||||||||||||||||||||||||||||||||||||||||||||||||||
301  QMYKGTVSMPVFQSLEAYWPGLQSLIGDIDNAMRTFLNYYTVWKQFGGLP  350

191  EFYNIPQGYTVEKREGYPLRPELIESAMYLYRATGDPTLLELGRDAVESI  240
     ||||||||||||||||||||||||||||||||||||||||||||||||||
351  EFYNIPQGYTVEKREGYPLRPELIESAMYLYRATGDPTLLELGRDAVESI  400

241  EKISKVECGFATIKDLRDHKLDNRMESFFLAETVKYLYLLFDPTNFIHNN  290
     ||||||||||||||||||||||||||||||||||||||||||||||||||
401  EKISKVECGFATIKDLRDHKLDNRMESFFLAETVKYLYLLFDPTNFIHNN  450

291  GSTFDAVITPYGECILGAGGYIFNTEAHPIDPAALHCCQRLKEEQWEVED  340
     ||||||||||||||||||||||||||||||||||||||||||||||||||
451  GSTFDAVITPYGECILGAGGYIFNTEAHPIDPAALHCCQRLKEEQWEVED  500
```

-continued

```
341  LMREFYSLKRSRSKFQKNTVSSGPWEPPARPGTLFSPENHDQARERKPAK  390
     |||||||||||||||||||||||||||||||||||||||||||||||||
501  LMREFYSLKRSRSKFQKNTVSSGPWEPPARPGTLFSPENHDQARERKPAK  550

391  QKVPLLSCPSQPPFTSKLALLGQVFLDSS                       418
     |||||||||||||||||||||||||||||
551  QKVPLLSCPSQPPFTSKLALLGQVFLDSS                       578
```

Sequence name: AAH16184 (SEQ ID NO:1460)
Sequence documentation:
Alignment of: R38144_PEA_2_P36 (SEQ ID NO:1408) x AAH16184 (SEQ ID NO:1460) ..
Alignment segment 1/1:

| | | | |
|---|---|---|---|
| Quality: | 364.00 | Escore: | 0 |
| Matching length: | 36 | Total length: | 36 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1  MPFRLLIPLGLLCALLPQHHGAPGPDGSAPDPAHYR  36
   |||||||||||||||||||||||||||||||||||
1  MPFRLLIPLGLLCALLPQHHGAPGPDGSAPDPAHYR  36
```

Sequence name: AAQ88943 (SEQ ID NO:1461)
Sequence documentation:
Alignment of: R38144_PEA_2_P36 (SEQ ID NO:1408) x AAQ88943 (SEQ ID NO:1461) ..
Alignment segment 1/1:

| | | | |
|---|---|---|---|
| Quality: | 362.00 | Escore: | 0 |
| Matching length: | 37 | Total length: | 37 |
| Matching Percent Similarity: | 97.30 | Matching Percent Identity: | 97.30 |
| Total Percent Similarity: | 97.30 | Total Percent Identity: | 97.30 |
| Gaps: | 0 | | |

Alignment:

```
1  MPFRLLIPLGLLCALLPQHHGAPGPDGSAPDPAHYRF  37
   ||||||||||||||||||||||||||||||||||| |
1  MPFRLLIPLGLLCALLPQHHGAPGPDGSAPDPAHYSF  37
```

Sequence name: CT31_HUMAN (SEQ ID NO:1459)
Sequence documentation:
Alignment of: R38144_PEA_2_P36 (SEQ ID NO:1408) x CT31_HUMAN (SEQ ID NO:1459) ..
Alignment segment 1/1:

| | | | |
|---|---|---|---|
| Quality: | 364.00 | Escore: | 0 |
| Matching length: | 36 | Total length: | 36 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1  MPFRLLIPLGLLCALLPQHHGAPGPDGSAPDPAHYR  36
   |||||||||||||||||||||||||||||||||||
1  MPFRLLIPLGLLCALLPQHHGAPGPDGSAPDPAHYR  36
```

Description for Cluster HUMOSTRO

Cluster HUMOSTRO features 3 transcript(s) and 30 segment(s) of interest, the names for which are given in Tables 1218 and 1219, respectively, the sequences themselves are given at the end of the application. The selected protein variants are given in table 1220.

TABLE 1218

Transcripts of interest

| Transcript Name | Sequence ID No. |
|---|---|
| HUMOSTRO_PEA_1_PEA_1_T14 | 141 |
| HUMOSTRO_PEA_1_PEA_1_T16 | 142 |
| HUMOSTRO_PEA_1_PEA_1_T30 | 143 |

TABLE 1219

Segments of interest

| Segment Name | Sequence ID No. |
|---|---|
| HUMOSTRO_PEA_1_PEA_1_node_0 | 961 |
| HUMOSTRO_PEA_1_PEA_1_node_10 | 962 |
| HUMOSTRO_PEA_1_PEA_1_node_16 | 963 |
| HUMOSTRO_PEA_1_PEA_1_node_23 | 964 |
| HUMOSTRO_PEA_1_PEA_1_node_31 | 965 |
| HUMOSTRO_PEA_1_PEA_1_node_43 | 966 |
| HUMOSTRO_PEA_1_PEA_1_node_3 | 967 |
| HUMOSTRO_PEA_1_PEA_1_node_5 | 968 |
| HUMOSTRO_PEA_1_PEA_1_node_7 | 969 |
| HUMOSTRO_PEA_1_PEA_1_node_8 | 970 |
| HUMOSTRO_PEA_1_PEA_1_node_15 | 971 |
| HUMOSTRO_PEA_1_PEA_1_node_17 | 972 |
| HUMOSTRO_PEA_1_PEA_1_node_20 | 973 |
| HUMOSTRO_PEA_1_PEA_1_node_21 | 974 |
| HUMOSTRO_PEA_1_PEA_1_node_22 | 975 |
| HUMOSTRO_PEA_1_PEA_1_node_24 | 976 |
| HUMOSTRO_PEA_1_PEA_1_node_26 | 977 |
| HUMOSTRO_PEA_1_PEA_1_node_27 | 978 |
| HUMOSTRO_PEA_1_PEA_1_node_28 | 979 |
| HUMOSTRO_PEA_1_PEA_1_node_29 | 980 |
| HUMOSTRO_PEA_1_PEA_1_node_30 | 981 |
| HUMOSTRO_PEA_1_PEA_1_node_32 | 982 |
| HUMOSTRO_PEA_1_PEA_1_node_34 | 983 |

TABLE 1219-continued

Segments of interest

| Segment Name | Sequence ID No. |
|---|---|
| HUMOSTRO_PEA_1_PEA_1_node_36 | 984 |
| HUMOSTRO_PEA_1_PEA_1_node_37 | 985 |
| HUMOSTRO_PEA_1_PEA_1_node_38 | 986 |
| HUMOSTRO_PEA_1_PEA_1_node_39 | 987 |
| HUMOSTRO_PEA_1_PEA_1_node_40 | 988 |
| HUMOSTRO_PEA_1_PEA_1_node_41 | 989 |
| HUMOSTRO_PEA_1_PEA_1_node_42 | 990 |

TABLE 1220

Proteins of interest

| Protein Name | Sequence ID No. | Corresponding Transcript(s) |
|---|---|---|
| HUMOSTRO_PEA_1_PEA_1_P21 | 1627 | HUMOSTRO_PEA_1_PEA_1_T14 (SEQ ID NO: 141) |
| HUMOSTRO_PEA_1_PEA_1_P25 | 1628 | HUMOSTRO_PEA_1_PEA_1_T16 (SEQ ID NO: 142) |
| HUMOSTRO_PEA_1_PEA_1_P30 | 1629 | HUMOSTRO_PEA_1_PEA_1_T30 (SEQ ID NO: 143) |

These sequences are variants of the known protein Osteopontin precursor (SwissProt accession identifier OSTP_HUMAN; known also according to the synonyms Bone sialoprotein 1; Urinary stone protein; Secreted phosphoprotein 1; SPP-1; Nephropontin; Uropontin), SEQ ID NO:1462, referred to herein as the previously known protein.

Protein Osteopontin precursor (SEQ ID NO:1462) is known or believed to have the following function(s): Binds tightly to hydroxyapatite. Appears to form an integral part of the mineralized matrix. Probably important to cell-matrix interaction. Acts as a cytokine involved in enhancing production of interferon-gamma and interleukin-12 and reducing production of interleukin-10 and is essential in the pathway that leads to type I immunity (By similarity). The sequence for protein Osteopontin precursor is given at the end of the application, as "Osteopontin precursor amino acid sequence". Known polymorphisms for this sequence are as shown in Table 1221.

TABLE 1221

Amino acid mutations for Known Protein

| SNP position(s) on amino acid sequence | Comment |
|---|---|
| 301 | R -> H (in dbSNP: 4660). /FTId = VAR_014717. |
| 188 | D -> H |
| 237 | T -> A |
| 275-278 | SHEF -> GNSL |

Protein Osteopontin precursor (SEQ ID NO:1462) localization is believed to be Secreted.

The previously known protein also has the following indication(s) and/or potential therapeutic use(s): Regeneration, bone. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bone formation stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Musculoskeletal.

The following GO Annotation(s) apply to the previously known protein. The following annotation(s) were found: ossification; anti-apoptosis; inflammatory response; cell-matrix adhesion; cell-cell signaling, which are annotation(s) related to Biological Process; defense/immunity protein; cytokine; integrin ligand; protein binding; growth factor; apoptosis inhibitor, which are annotation(s) related to Molecular Function; and extracellular matrix, which are annotation(s) related to Cellular Component.

The GO assignment relies on information from one or more of the SwissProt/TremB1 Protein knowledgebase, available from <dot expasy dot ch/sprot>; or Locuslink, available from <dot ncbi dot nlm dot nih dot gov/projects/LocusLink/>.

Cluster HUMOSTRO can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 46 refer to weighted expression of ESTs in each category, as "parts per million" (ratio of the expression of ESTs for a particular cluster to the expression of all ESTs in that category, according to parts per million).

Figure 46:
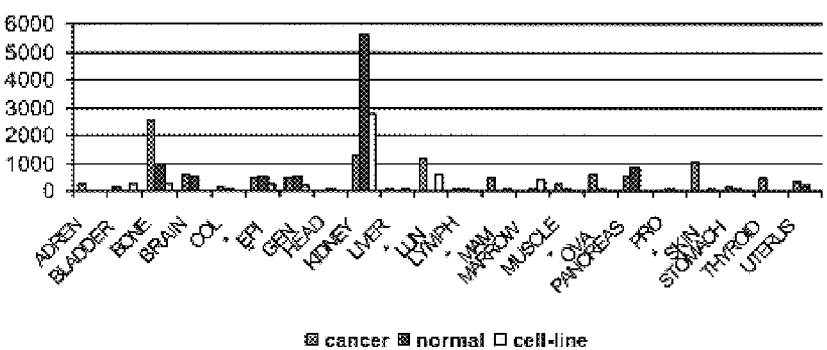
FIG. 46 is a histogram showing Cancer and cell-line vs. normal tissue expression for Cluster HUMOSTRO, demonstrating overexpression in epithelial malignant tumors, a mixture of malignant tumors from different tissues, lung malignant tumors, breast malignant tumors, ovarian carcinoma and skin malignancies.

Overall, the following results were obtained as shown with regard to the histograms in FIG. 46 and Table 1222. This cluster is overexpressed (at least at a minimum level) in the following pathological conditions: epithelial malignant tumors, a mixture of malignant tumors from different tissues, lung malignant tumors, breast malignant tumors, ovarian carcinoma and skin malignancies.

TABLE 1222

Normal tissue distribution

| Name of Tissue | Number |
|---|---|
| Adrenal | 4 |
| Bladder | 0 |
| Bone | 897 |
| Brain | 506 |
| Colon | 69 |
| Epithelial | 548 |
| General | 484 |
| head and neck | 50 |
| Kidney | 5618 |
| Liver | 4 |
| Lung | 10 |

TABLE 1222-continued

Normal tissue distribution

| Name of Tissue | Number |
|---|---|
| lymph nodes | 75 |
| Breast | 8 |
| bone marrow | 62 |
| Muscle | 37 |
| Ovary | 40 |
| Pancreas | 845 |
| Prostate | 48 |
| Skin | 13 |
| Stomach | 73 |
| Thyroid | 0 |
| Uterus | 168 |

TABLE 1223

P values and ratios for expression in cancerous tissue

| Name of Tissue | P1 | P2 | SP1 | R3 | SP2 | R4 |
|---|---|---|---|---|---|---|
| Adrenal | 1.5e−01 | 2.1e−01 | 2.0e−02 | 4.6 | 4.4e−02 | 3.6 |
| Bladder | 1.2e−01 | 9.2e−02 | 5.7e−02 | 4.1 | 2.1e−02 | 4.3 |
| Bone | 4.9e−01 | 7.4e−01 | 4.1e−06 | 0.6 | 5.4e−01 | 0.4 |
| Brain | 6.6e−01 | 7.0e−01 | 3.2e−01 | 0.6 | 1 | 0.4 |
| Colon | 2.7e−01 | 4.0e−01 | 3.1e−01 | 1.5 | 5.2e−01 | 1.1 |
| Epithelial | 2.0e−07 | 1.6e−03 | 9.8e−01 | 0.7 | 1 | 0.5 |
| General | 1.2e−06 | 1.2e−02 | 7.9e−01 | 0.8 | 1 | 0.6 |
| head and neck | 3.4e−01 | 5.0e−01 | 1 | 0.7 | 1 | 0.7 |
| Kidney | 6.8e−01 | 7.4e−01 | 1 | 0.2 | 1 | 0.1 |
| Liver | 3.3e−01 | 2.5e−01 | 1 | 1.8 | 2.3e−01 | 2.6 |
| Lung | 4.3e−04 | 4.6e−03 | 2.1e−30 | 15.0 | 2.8e−27 | 23.5 |
| lymph nodes | 6.7e−01 | 8.7e−01 | 8.1e−01 | 0.7 | 9.9e−01 | 0.3 |
| Breast | 2.3e−01 | 3.0e−01 | 1.9e−04 | 6.2 | 4.1e−03 | 4.3 |
| bone marrow | 7.5e−01 | 7.8e−01 | 1 | 0.3 | 2.0e−02 | 1.2 |
| Muscle | 4.0e−02 | 7.5e−02 | 1.1e−01 | 4.6 | 5.1e−01 | 1.5 |
| Ovary | 4.7e−02 | 8.4e−02 | 1.9e−05 | 5.4 | 8.3e−04 | 3.7 |
| Pancreas | 5.0e−02 | 3.3e−01 | 1 | 0.3 | 1 | 0.2 |
| Prostate | 8.5e−01 | 9.0e−01 | 8.9e−01 | 0.7 | 9.5e−01 | 0.6 |
| Skin | 1.6e−01 | 1.6$^e$−01 | 1.2e−10 | 12.6 | 5.2e−04 | 4.1 |
| Stomach | 1.5e−01 | 6.3$^e$−01 | 5.0e−01 | 1.2 | 9.4e−01 | 0.6 |
| Thyroid | 2.9e−01 | 2.9e−01 | 5.9e−02 | 2.0 | 5.9e−02 | 2.0 |
| Uterus | 6.1e−02 | 5.7$^e$−01 | 1.1e−01 | 1.3 | 7.0e−01 | 0.7 |

As noted above, cluster HUMOSTRO features 3 transcript (s), which were listed in Table 1 above. These transcript(s) encode for protein(s) which are variant(s) of protein Osteopontin precursor (SEQ ID NO:1462). A description of each variant protein according to the present invention is now provided.

Variant protein HUMOSTRO_PEA_1_PEA_1_P21 (SEQ ID NO:1627) according to the present invention has an amino acid sequence as given at the end of the application; it is encoded by transcript(s) HUMOSTRO_PEA_1_PEA_1_T14 (SEQ ID NO:141). An alignment is given to the known protein (Osteopontin precursor (SEQ ID NO:1462)) at the end of the application. One or more alignments to one or more previously published protein sequences are given at the end of the application. A brief description of the relationship of the variant protein according to the present invention to each such aligned protein is as follows:

Comparison Report Between HUMOSTRO_PEA_1_PEA_1_P21 (SEQ ID NO:1627) and OSTP_HUMAN (SEQ ID NO:1462):

1. An isolated chimeric polypeptide encoding for HUMOSTRO_PEA_1_PEA_1_P21 (SEQ ID NO:1627), comprising a first amino acid sequence being at least 90% homologous to MRIAVICFCLLGITCAIPVKQADSGS-SEEKQLYNKYPDAVATWLNPDPSQKQNLLAPQ corresponding to amino acids 1-58 of OSTP_HUMAN (SEQ ID NO:1462), which also corresponds to amino acids 1-58 of HUMOSTRO_PEA_1_PEA_1_P21 (SEQ ID NO:1627), and a second amino acid sequence being at least 70%, optionally at least 80%, preferably at least 85%, more preferably at least 90% and most preferably at least 95% homologous to a polypeptide having the sequence VFLNFS (SEQ ID NO: 261) corresponding to amino acids 59-64 of HUMOSTRO_PEA_1_PEA_1_P21 (SEQ ID NO:1627), wherein said first amino acid sequence and second amino acid sequence are contiguous and in a sequential order.

2. An isolated polypeptide encoding for a tail of HUMOSTRO_PEA_1_PEA_1_P21 (SEQ ID NO:1627), comprising a polypeptide being at least 70%, optionally at least about 80%, preferably at least about 85%, more preferably at least about 90% and most preferably at least about 95% homologous to the sequence VFLNFS (SEQ ID NO: 261) in HUMOSTRO_PEA_1_PEA_1_P21 (SEQ ID NO:1627).

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMOSTRO_PEA_1_PEA_1_P21 (SEQ ID NO:1627) also has the following non-silent SNPs (Single Nucleotide Polymorphisms) as listed in Table 1224, (given according to their position(s) on the amino acid sequence, with the alternative amino acid(s) listed; the last column indicates whether the SNP is known or not; the presence of known SNPs in variant protein HUMOSTRO_PEA_1_PEA_1_P21 (SEQ ID NO:1627) sequence provides support for the deduced sequence of this variant protein according to the present invention).

TABLE 1224

Amino acid mutations

| SNP position(s) on amino acid sequence | Alternative amino acid(s) | Previously known SNP? |
|---|---|---|
| 7 | C -> W | No |
| 31 | Q -> R | No |
| 47 | D -> V | Yes |
| 49 | S -> P | No |

The glycosylation sites of variant protein HUMOSTRO_PEA_1_PEA_1_P21 (SEQ ID NO:1627), as compared to the known protein Osteopontin precursor (SEQ ID NO:1462), are described in Table 1225 (given according to their position(s) on the amino acid sequence in the first column; the second column indicates whether the glycosylation site is present in the variant protein; and the last column indicates whether the position is different on the variant protein).

TABLE 1225

Glycosylation site(s)

| Position(s) on known amino acid sequence | Present in variant protein? |
|---|---|
| 79 | no |
| 106 | no |

Variant protein HUMOSTRO_PEA_1_PEA_1_P21 (SEQ ID NO:1627) is encoded by the following transcript(s): HUMOSTRO_PEA_1_PEA_1_T14 (SEQ ID NO:141), for which the sequence(s) is/are given at the end of the application. The coding portion of transcript HUMOSTRO_PEA_1_PEA_1_T14 (SEQ ID NO:141) is shown in bold; this coding portion starts at position 199 and ends at position 390. The transcript also has the following SNPs as listed in Table 1226 (given according to their position on the nucleotide sequence, with the alternative nucleic acid listed; the last column indicates whether the SNP is known or not; the presence of known SNPs in variant protein HUMOSTRO_PEA_1_PEA_1_P21 (SEQ ID NO:627) sequence provides support for the deduced sequence of this variant protein according to the present invention).

TABLE 1226

| Nucleic acid SNPs | | |
|---|---|---|
| SNP position on nucleotide sequence | Alternative nucleic acid | Previously known SNP? |
| 136 | A -> G | Yes |
| 154 | T -> | No |
| 159 | G -> T | Yes |
| 219 | C -> G | No |
| 274 | -> G | No |
| 290 | A -> G | No |
| 338 | A -> T | Yes |
| 343 | T -> C | No |
| 413 | G -> C | Yes |
| 707 | C -> T | Yes |
| 708 | C -> A | Yes |
| 715 | A -> G | Yes |
| 730 | A -> C | No |
| 730 | A -> G | No |
| 746 | T -> C | Yes |
| 767 | C -> T | No |
| 779 | G -> A | Yes |
| 866 | -> G | No |
| 869 | T -> | No |
| 889 | -> A | No |
| 891 | A -> C | No |
| 891 | A -> G | No |
| 905 | T -> C | No |
| 910 | -> G | No |
| 910 | -> T | No |
| 997 | A -> G | No |
| 1026 | G -> C | No |
| 1042 | -> G | No |
| 1042 | -> T | No |
| 1071 | A -> | No |
| 1071 | A -> C | No |
| 1098 | A -> | No |
| 1105 | C -> T | No |
| 1124 | -> G | No |
| 1135 | G -> A | Yes |
| 1136 | T -> | No |
| 1136 | T -> G | No |
| 1173 | A -> C | No |
| 1173 | A -> G | No |
| 1179 | A -> G | No |
| 1214 | C -> T | Yes |
| 1246 | T -> | No |
| 1246 | T -> A | No |
| 1359 | A -> | No |
| 1359 | A -> G | No |
| 1362 | T -> | No |
| 1365 | C -> T | Yes |
| 1366 | G -> A | Yes |
| 1408 | A -> C | No |
| 1418 | A -> C | No |
| 1433 | A -> C | No |
| 1456 | A -> C | No |
| 1524 | T -> A | No |
| 1524 | T -> C | No |
| 1547 | A -> G | Yes |

TABLE 1226-continued

| Nucleic acid SNPs | | |
|---|---|---|
| SNP position on nucleotide sequence | Alternative nucleic acid | Previously known SNP? |
| 1553 | T -> | No |
| 1574 | -> G | No |
| 1654 | A -> C | Yes |
| 1691 | A -> G | No |
| 1703 | A -> C | Yes |
| 1755 | A -> C | No |
| 1764 | T -> | No |

Variant protein HUMOSTRO_PEA_1_PEA_1_P25 (SEQ ID NO:1628) according to the present invention has an amino acid sequence as given at the end of the application; it is encoded by transcript(s) HUMOSTRO_PEA_1_PEA_1_T16 (SEQ ID NO:142). An alignment is given to the known protein (Osteopontin precursor (SEQ ID NO:1462)) at the end of the application. One or more alignments to one or more previously published protein sequences are given at the end of the application. A brief description of the relationship of the variant protein according to the present invention to each such aligned protein is as follows:

Comparison Report Between HUMOSTRO_PEA_1_PEA_1_P25 (SEQ ID NO:1628) and OSTP_HUMAN (SEQ ID NO:1462):

1. An isolated chimeric polypeptide encoding for HUMOSTRO_PEA_1_PEA_1_P25 (SEQ ID NO:1628), comprising a first amino acid sequence being at least 90% homologous to MRIAVICFCLLGITCAIPVKQADSGS-SEEKQ corresponding to amino acids 1-31 of OSTP_HUMAN (SEQ ID NO:1462), which also corresponds to amino acids 1-31 of HUMOSTRO_PEA_1_PEA_1_P25 (SEQ ID NO:1628), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA_1_PEA_1_P25 (SEQ ID NO:1628), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA_1_PEA_1_P25 (SEQ ID NO:1628) also has the following non-silent SNPs (Single Nucleotide Polymorphisms) as listed in Table 1227, (given according to their position(s) on the amino acid sequence, with the alternative amino acid(s) listed; the last column indicates whether the SNP is known or not; the presence of known SNPs in variant protein HUMOSTRO_PEA_1_PEA_1_P25 (SEQ ID NO:1628) sequence provides support for the deduced sequence of this variant protein according to the present invention).

TABLE 1227

| SNP position(s) on amino acid sequence | Alternative amino acid(s) | Previously known SNP? |
|---|---|---|
| 7 | C -> W | No |
| 31 | Q -> R | No |

The glycosylation sites of variant protein HUMOSTRO_PEA_1_PEA_1_P25 (SEQ ID NO:1628), as compared to the known protein Osteopontin precursor (SEQ ID NO:1462), are described in Table 1228 (given according to their position(s) on the amino acid sequence in the first column; the second column indicates whether the glycosylation site is present in the variant protein; and the last column indicates whether the position is different on the variant protein).

TABLE 1228

| Glycosylation site(s) | |
|---|---|
| Position(s) on known amino acid sequence | Present in variant protein? |
| 79 | no |
| 106 | no |

Variant protein HUMOSTRO_PEA_1_PEA_1_P25 (SEQ ID NO:1628) is encoded by the following transcript(s): HUMOSTRO_PEA_1_PEA_1_T16 (SEQ ID NO:142), for which the sequence(s) is/are given at the end of the application. The coding portion of transcript HUMOSTRO_PEA_1_PEA_1_T16 (SEQ ID NO:142) is shown in bold; this coding portion starts at position 199 and ends at position 294. The transcript also has the following SNPs as listed in Table 1229 (given according to their position on the nucleotide sequence, with the alternative nucleic acid listed; the last column indicates whether the SNP is known or not; the presence of known SNPs in variant protein HUMOSTRO_PEA_1_PEA_1_P25 (SEQ ID NO:1628) sequence provides support for the deduced sequence of this variant protein according to the present invention).

TABLE 1229

| Nucleic acid SNPs | | |
|---|---|---|
| SNP position on nucleotide sequence | Alternative nucleic acid | Previously known SNP? |
| 136 | A -> G | Yes |
| 154 | T -> | No |
| 159 | G -> T | Yes |
| 219 | C -> G | No |
| 274 | -> G | No |
| 290 | A -> G | No |
| 419 | C -> T | Yes |
| 454 | G -> C | Yes |
| 527 | A -> T | Yes |
| 532 | T -> C | No |
| 630 | C -> T | Yes |
| 631 | C -> A | Yes |
| 638 | A -> G | Yes |
| 653 | A -> C | No |
| 653 | A -> G | No |
| 669 | T -> C | Yes |
| 690 | C -> T | No |
| 702 | G -> A | Yes |
| 789 | -> G | No |

TABLE 1229-continued

| Nucleic acid SNPs | | |
|---|---|---|
| SNP position on nucleotide sequence | Alternative nucleic acid | Previously known SNP? |
| 792 | T -> | No |
| 812 | -> A | No |
| 814 | A -> C | No |
| 814 | A -> G | No |
| 828 | T -> C | No |
| 833 | -> G | No |
| 833 | -> T | No |
| 920 | A -> G | No |
| 949 | G -> C | No |
| 965 | -> G | No |
| 965 | -> T | No |
| 994 | A -> | No |
| 994 | A -> C | No |
| 1021 | A -> | No |
| 1028 | C -> T | No |
| 1047 | -> G | No |
| 1058 | G -> A | Yes |
| 1059 | T -> | No |
| 1059 | T -> G | No |
| 1096 | A -> C | No |
| 1096 | A -> G | No |
| 1102 | A -> G | No |
| 1137 | C -> T | Yes |
| 1169 | T -> | No |
| 1169 | T -> A | No |
| 1282 | A -> | No |
| 1282 | A -> G | No |
| 1285 | T -> | No |
| 1288 | C -> T | Yes |
| 1289 | G -> A | Yes |
| 1331 | A -> C | No |
| 1341 | A -> C | No |
| 1356 | A -> C | No |
| 1379 | A -> C | No |
| 1447 | T -> A | No |
| 1447 | T -> C | No |
| 1470 | A -> G | Yes |
| 1476 | T -> | No |
| 1497 | -> G | No |
| 1577 | A -> C | Yes |
| 1614 | A -> G | No |
| 1626 | A -> C | Yes |
| 1678 | A -> C | No |
| 1687 | T -> | No |

Variant protein HUMOSTRO_PEA_1_PEA_1_P30 (SEQ ID NO:1629) according to the present invention has an amino acid sequence as given at the end of the application; it is encoded by transcript(s) HUMOSTRO_PEA_1_PEA_1_T30 (SEQ ID NO:143). An alignment is given to the known protein (Osteopontin precursor (SEQ ID NO:1462)) at the end of the application. One or more alignments to one or more previously published protein sequences are given at the end of the application. A brief description of the relationship of the variant protein according to the present invention to each such aligned protein is as follows:

Comparison Report Between HUMOSTRO_PEA_1_PEA_1_P30 (SEQ ID NO:1629) and OSTP_HUMAN (SEQ ID NO:1462):

1. An isolated chimeric polypeptide encoding for HUMOSTRO_PEA_1_PEA_1_P30 (SEQ ID NO:1629), comprising a first amino acid sequence being at least 90% homologous to MRIAVICFCLLGITCAIPVKQADSGS-SEEKQ corresponding to amino acids 1-31 of OSTP_HUMAN (SEQ ID NO:1462), which also corresponds to amino acids 1-31 of HUMOSTRO_PEA_1_PEA_1_P30 (SEQ ID NO:1629), and a second amino acid sequence being at least 70%, optionally at least 80%, preferably at least 85%, more preferably at least 90% and most preferably at least 95% homologous to a polypeptide having the sequence VSIFYVFI (SEQ ID NO: 262) corresponding to amino acids 32-39 of HUMOSTRO_PEA_1_PEA_1_P30 (SEQ ID NO:1629), wherein said first amino acid sequence and second amino acid sequence are contiguous and in a sequential order.

2. An isolated polypeptide encoding for a tail of HUMOS-TRO_PEA_1_PEA_1_P30 (SEQ ID NO:1629), comprising a polypeptide being at least 70%, optionally at least about 80%, preferably at least about 85%, more preferably at least about 90% and most preferably at least about 95% homologous to the sequence VSIFYVFI (SEQ ID NO: 262) in HUMOSTRO_PEA_1_PEA_1_P30 (SEQ ID NO:1629).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA_1_PEA_1_P30 (SEQ ID NO:1629) also has the following non-silent SNPs (Single Nucleotide Polymorphisms) as listed in Table 1230, (given according to their position(s) on the amino acid sequence, with the alternative amino acid(s) listed; the last column indicates whether the SNP is known or not; the presence of known SNPs in variant protein HUMOSTRO_PEA_1_PEA_1_P30 (SEQ ID NO:1629) sequence provides support for the deduced sequence of this variant protein according to the present invention).

TABLE 1230

Amino acid mutations

| SNP position(s) on amino acid sequence | Alternative amino acid(s) | Previously known SNP? |
|---|---|---|
| 7 | C -> W | No |
| 31 | Q -> R | No |

The glycosylation sites of variant protein HUMOSTRO_PEA_1_PEA_1_P30 (SEQ ID NO:1629), as compared to the known protein Osteopontin precursor (SEQ ID NO:1462), are described in Table 1231 (given according to their position(s) on the amino acid sequence in the first column; the second column indicates whether the glycosylation site is present in the variant protein; and the last column indicates whether the position is different on the variant protein).

TABLE 1231

Glycosylation site(s)

| Position(s) on known amino acid sequence | Present in variant protein? |
|---|---|
| 79 | no |
| 106 | no |

Variant protein HUMOSTRO_PEA_1_PEA_1_P30 (SEQ ID NO:1629) is encoded by the following transcript(s): HUMOSTRO_PEA_1_PEA_1_T30 (SEQ ID NO:143), for which the sequence(s) is/are given at the end of the application. The coding portion of transcript HUMOSTRO_PEA_1_PEA_1_T30 (SEQ ID NO:143) is shown in bold; this coding portion starts at position 199 and ends at position 315. The transcript also has the following SNPs as listed in Table 1232 (given according to their position on the nucleotide sequence, with the alternative nucleic acid listed; the last column indicates whether the SNP is known or not; the presence of known SNPs in variant protein HUMOSTRO_PEA_1_PEA_1_P30 (SEQ ID NO:1629) sequence provides support for the deduced sequence of this variant protein according to the present invention).

TABLE 1232

Nucleic acid SNPs

| SNP position on nucleotide sequence | Alternative nucleic acid | Previously known SNP? |
|---|---|---|
| 136 | A -> G | Yes |
| 154 | T -> | No |
| 159 | G -> T | Yes |
| 219 | C -> G | No |
| 274 | -> G | No |
| 290 | A -> G | No |

As noted above, cluster HUMOSTRO features 30 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMOSTRO_PEA_1_PEA_1_node_0 (SEQ ID NO:961) according to the present invention is supported by 333 libraries. The number of libraries was determined as previously described. This segment can be found in the following transcript(s): HUMOSTRO_PEA_1_PEA_1_T14 (SEQ ID NO:141), HUMOSTRO_PEA_1_PEA_1_T16 (SEQ ID NO:142) and HUMOSTRO_PEA_1_PEA_1_T30 (SEQ ID NO:143). Table 1233 below describes the starting and ending position of this segment on each transcript.

TABLE 1234

Segment location on transcripts

| Transcript name | Segment starting position | Segment ending position |
|---|---|---|
| HUMOSTRO_PEA_1_PEA_1_T14 (SEQ ID NO: 141) | 1 | 184 |
| HUMOSTRO_PEA_1_PEA_1_T16 (SEQ ID NO: 142) | 1 | 184 |
| HUMOSTRO_PEA_1_PEA_1_T30 (SEQ ID NO: 143) | 1 | 184 |

Segment cluster HUMOSTRO_PEA_1_PEA_1_node_10 (SEQ ID NO:962) according to the present invention is supported by 4 libraries. The number of libraries was determined as previously described. This segment can be found in the following transcript(s): HUMOSTRO_PEA_1_PEA_1_T16 (SEQ ID NO:142). Table 1235 below describes the starting and ending position of this segment on each transcript.

TABLE 1235

Segment location on transcripts

| Transcript name | Segment starting position | Segment ending position |
|---|---|---|
| HUMOSTRO_PEA_1_PEA_1_T16 (SEQ ID NO: 142) | 292 | 480 |

Segment cluster HUMOSTRO_PEA_1_PEA_1_node_16 (SEQ ID NO:963) according to the present invention is supported by 6 libraries. The number of libraries was determined as previously described. This segment can be found in the following transcript(s): HUMOSTRO_PEA_1_PEA_1_T14 (SEQ ID NO:141). Table 1236 below describes the starting and ending position of this segment on each transcript.

TABLE 1236

Segment location on transcripts

| Transcript name | Segment starting position | Segment ending position |
|---|---|---|
| HUMOSTRO_PEA_1_PEA_1_T14 (SEQ ID NO: 141) | 373 | 638 |

Segment cluster HUMOSTRO_PEA_1_PEA_1_node_23 (SEQ ID NO:964) according to the present invention is supported by 334 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1237 below describes the starting and ending position of this segment on each transcript.

TABLE 1237

Segment location on transcripts

| Transcript name | Segment starting position | Segment ending position |
|---|---|---|
| HUMOSTRO_PEA_1_PEA_1_T14 (SEQ ID NO: 141) | 804 | 967 |
| HUMOSTRO_PEA_1_PEA_1_T16 (SEQ ID NO: 142) | 727 | 890 |

Segment cluster HUMOSTRO_PEA_1_PEA_1_node_31 (SEQ ID NO:965) according to the present invention is supported by 350 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1238 below describes the starting and ending position of this segment on each transcript.

TABLE 1238

Segment location on transcripts

| Transcript name | Segment starting position | Segment ending position |
|---|---|---|
| HUMOSTRO_PEA_1_PEA_1_T14 (SEQ ID NO: 141) | 1164 | 1393 |
| HUMOSTRO_PEA_1_PEA_1_T16 (SEQ ID NO: 142) | 1087 | 1316 |

Segment cluster HUMOSTRO_PEA_1_PEA_1_node_43 (SEQ ID NO:966) according to the present invention is supported by 192 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1239 below describes the starting and ending position of this segment on each transcript.

TABLE 1239

Segment location on transcripts

| Transcript name | Segment starting position | Segment ending position |
|---|---|---|
| HUMOSTRO_PEA_1_PEA_1_T14 (SEQ ID NO: 141) | 1810 | 1846 |
| HUMOSTRO_PEA_1_PEA_1_T16 (SEQ ID NO: 142) | 1733 | 1769 |

According to an optional embodiment of the present invention, short segments related to the above cluster are also provided. These segments are up to about 120 bp in length, and so are included in a separate description.

Segment cluster HUMOSTRO_PEA_1_PEA_1_node_3 (SEQ ID NO:967) according to the present invention is supported by 353 libraries. The number of libraries was determined as previously described. This segment can be found in the following transcript(s): HUMOSTRO_PEA_1_PEA_1_T14 (SEQ ID NO:141), HUMOSTRO_PEA_1_PEA_1_T16 (SEQ ID NO:142) and HUMOSTRO_PEA_1_PEA_1_T30 (SEQ ID NO:143). Table 1240 below describes the starting and ending position of this segment on each transcript.

TABLE 1240

Segment location on transcripts

| Transcript name | Segment starting position | Segment ending position |
|---|---|---|
| HUMOSTRO_PEA_1_PEA_1_T14 (SEQ ID NO: 141) | 185 | 210 |
| HUMOSTRO_PEA_1_PEA_1_T16 (SEQ ID NO: 142) | 185 | 210 |
| HUMOSTRO_PEA_1_PEA_1_T30 (SEQ ID NO: 143) | 185 | 210 |

Segment cluster HUMOSTRO_PEA_1_PEA_1_node_5 (SEQ ID NO:968) according to the present invention is supported by 353 libraries. The number of libraries was determined as previously described. This segment can be found in the following transcript(s): HUMOSTRO_PEA_

1_PEA_1_T14 (SEQ ID NO:141), HUMOSTRO_PEA_1_PEA_1_T16 (SEQ ID NO:142) and HUMOSTRO_PEA_1_PEA_1_T30 (SEQ ID NO:143). Table 1241 below describes the starting and ending position of this segment on each transcript.

TABLE 1241

Segment location on transcripts

| Transcript name | Segment starting position | Segment ending position |
|---|---|---|
| HUMOSTRO_PEA_1_PEA_1_T14 (SEQ ID NO: 141) | 211 | 252 |
| HUMOSTRO_PEA_1_PEA_1_T16 (SEQ ID NO: 142) | 211 | 252 |
| HUMOSTRO_PEA_1_PEA_1_T30 (SEQ ID NO: 143) | 211 | 252 |

Segment cluster HUMOSTRO_PEA_1_PEA_1_node_7 (SEQ ID NO:969) according to the present invention is supported by 357 libraries. The number of libraries was determined as previously described. This segment can be found in the following transcript(s): HUMOSTRO_PEA_1_PEA_1_T14 (SEQ ID NO:141), HUMOSTRO_PEA_1_PEA_1_T16 (SEQ ID NO:142) and HUMOSTRO_PEA_1_PEA_1_T30 (SEQ ID NO:143). Table 1242 below describes the starting and ending position of this segment on each transcript.

TABLE 1242

Segment location on transcripts

| Transcript name | Segment starting position | Segment ending position |
|---|---|---|
| HUMOSTRO_PEA_1_PEA_1_T14 (SEQ ID NO: 141) | 253 | 291 |
| HUMOSTRO_PEA_1_PEA_1_T16 (SEQ ID NO: 142) | 253 | 291 |
| HUMOSTRO_PEA_1_PEA_1_T30 (SEQ ID NO: 143) | 253 | 291 |

Segment cluster HUMOSTRO_PEA_1_PEA_1_node_8 (SEQ ID NO:970) according to the present invention is supported by 1 libraries. The number of libraries was determined as previously described. This segment can be found in the following transcript(s): HUMOSTRO_PEA_1_PEA_1_T30 (SEQ ID NO:143). Table 1243 below describes the starting and ending position of this segment on each transcript.

TABLE 1243

Segment location on transcripts

| Transcript name | Segment starting position | Segment ending position |
|---|---|---|
| HUMOSTRO_PEA_1_PEA_1_T30 (SEQ ID NO: 143) | 292 | 378 |

Segment cluster HUMOSTRO_PEA_1_PEA_1_node_15 (SEQ ID NO:971) according to the present invention is supported by 366 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1244 below describes the starting and ending position of this segment on each transcript.

TABLE 1244

Segment location on transcripts

| Transcript name | Segment starting position | Segment ending position |
|---|---|---|
| HUMOSTRO_PEA_1_PEA_1_T14 (SEQ ID NO: 141) | 292 | 372 |
| HUMOSTRO_PEA_1_PEA_1_T16 (SEQ ID NO: 142) | 481 | 561 |

Segment cluster HUMOSTRO_PEA_1_PEA_1_node_17 (SEQ ID NO:972) according to the present invention is supported by 261 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1245 below describes the starting and ending position of this segment on each transcript.

TABLE 1245

Segment location on transcripts

| Transcript name | Segment starting position | Segment ending position |
|---|---|---|
| HUMOSTRO_PEA_1_PEA_1_T14 (SEQ ID NO: 141) | 639 | 680 |
| HUMOSTRO_PEA_1_PEA_1_T16 (SEQ ID NO: 142) | 562 | 603 |

Segment cluster HUMOSTRO_PEA_1_PEA_1_node_20 (SEQ ID NO:973) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1246 below describes the starting and ending position of this segment on each transcript.

TABLE 1246

Segment location on transcripts

| Transcript name | Segment starting position | Segment ending position |
|---|---|---|
| HUMOSTRO_PEA_1_PEA_1_T14 (SEQ ID NO: 141) | 681 | 688 |
| HUMOSTRO_PEA_1_PEA_1_T16 (SEQ ID NO: 142) | 604 | 611 |

Segment cluster HUMOSTRO_PEA_1_PEA_1_node_21 (SEQ ID NO:974) according to the present invention is supported by 315 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1247 below describes the starting and ending position of this segment on each transcript.

TABLE 1247

Segment location on transcripts

| Transcript name | Segment starting position | Segment ending position |
|---|---|---|
| HUMOSTRO_PEA_1_PEA_1_T14 (SEQ ID NO: 141) | 689 | 738 |
| HUMOSTRO_PEA_1_PEA_1_T16 (SEQ ID NO: 142) | 612 | 661 |

Segment cluster HUMOSTRO_PEA_1_PEA_1_node_22 (SEQ ID NO:975) according to the present invention is supported by 322 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1248 below describes the starting and ending position of this segment on each transcript.

TABLE 1248

Segment location on transcripts

| Transcript name | Segment starting position | Segment ending position |
|---|---|---|
| HUMOSTRO_PEA_1_PEA_1_T14 (SEQ ID NO: 141) | 739 | 803 |
| HUMOSTRO_PEA_1_PEA_1_T16 (SEQ ID NO: 142) | 662 | 726 |

Segment cluster HUMOSTRO_PEA_1_PEA_1_node_24 (SEQ ID NO:976) according to the present invention is supported by 270 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1249 below describes the starting and ending position of this segment on each transcript.

TABLE 1249

Segment location on transcripts

| Transcript name | Segment starting position | Segment ending position |
|---|---|---|
| HUMOSTRO_PEA_1_PEA_1_T14 (SEQ ID NO: 141) | 968 | 1004 |
| HUMOSTRO_PEA_1_PEA_1_T16 (SEQ ID NO: 142) | 891 | 927 |

Segment cluster HUMOSTRO_PEA_1_PEA_1_node_26 (SEQ ID NO:977) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1250 below describes the starting and ending position of this segment on each transcript.

TABLE 1250

Segment location on transcripts

| Transcript name | Segment starting position | Segment ending position |
|---|---|---|
| HUMOSTRO_PEA_1_PEA_1_T14 (SEQ ID NO: 141) | 1005 | 1022 |
| HUMOSTRO_PEA_1_PEA_1_T16 (SEQ ID NO: 142) | 928 | 945 |

Segment cluster HUMOSTRO_PEA_1_PEA_1_node_27 (SEQ ID NO:978) according to the present invention is supported by 260 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1251 below describes the starting and ending position of this segment on each transcript.

TABLE 1251

Segment location on transcripts

| Transcript name | Segment starting position | Segment ending position |
|---|---|---|
| HUMOSTRO_PEA_1_PEA_1_T14 (SEQ ID NO: 141) | 1023 | 1048 |
| HUMOSTRO_PEA_1_PEA_1_T16 (SEQ ID NO: 142) | 946 | 971 |

Segment cluster HUMOSTRO_PEA_1_PEA_1_node_28 (SEQ ID NO:979) according to the present invention is supported by 273 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1252 below describes the starting and ending position of this segment on each transcript.

TABLE 1252

Segment location on transcripts

| Transcript name | Segment starting position | Segment ending position |
|---|---|---|
| HUMOSTRO_PEA_1_PEA_1_T14 (SEQ ID NO: 141) | 1049 | 1100 |
| HUMOSTRO_PEA_1_PEA_1_T16 (SEQ ID NO: 142) | 972 | 1023 |

Segment cluster HUMOSTRO_PEA_1_PEA_1_node_29 (SEQ ID NO:980) according to the present invention is supported by 272 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1253 below describes the starting and ending position of this segment on each transcript.

TABLE 1253

Segment location on transcripts

| Transcript name | Segment starting position | Segment ending position |
|---|---|---|
| HUMOSTRO_PEA_1_PEA_1_T14 (SEQ ID NO: 141) | 1101 | 1151 |
| HUMOSTRO_PEA_1_PEA_1_T16 (SEQ ID NO: 142) | 1024 | 1074 |

Segment cluster HUMOSTRO_PEA_1_PEA_1_node_30 (SEQ ID NO:981) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1254 below describes the starting and ending position of this segment on each transcript.

TABLE 1254

Segment location on transcripts

| Transcript name | Segment starting position | Segment ending position |
|---|---|---|
| HUMOSTRO_PEA_1_PEA_1_T14 (SEQ ID NO: 141) | 1152 | 1163 |
| HUMOSTRO_PEA_1_PEA_1_T16 (SEQ ID NO: 142) | 1075 | 1086 |

Segment cluster HUMOSTRO_PEA_1_PEA_1_node_32 (SEQ ID NO:982) according to the present invention is supported by 293 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1255 below describes the starting and ending position of this segment on each transcript.

TABLE 1255

Segment location on transcripts

| Transcript name | Segment starting position | Segment ending position |
|---|---|---|
| HUMOSTRO_PEA_1_PEA_1_T14 (SEQ ID NO: 141) | 1394 | 1427 |
| HUMOSTRO_PEA_1_PEA_1_T16 (SEQ ID NO: 142) | 1317 | 1350 |

Segment cluster HUMOSTRO_PEA_1_PEA_1_node_34 (SEQ ID NO:983) according to the present invention is supported by 301 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1256 below describes the starting and ending position of this segment on each transcript.

TABLE 1256

Segment location on transcripts

| Transcript name | Segment starting position | Segment ending position |
|---|---|---|
| HUMOSTRO_PEA_1_PEA_1_T14 (SEQ ID NO: 141) | 1428 | 1468 |
| HUMOSTRO_PEA_1_PEA_1_T16 (SEQ ID NO: 142) | 1351 | 1391 |

Segment cluster HUMOSTRO_PEA_1_PEA_1_node_36 (SEQ ID NO:984) according to the present invention is supported by 292 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1257 below describes the starting and ending position of this segment on each transcript.

TABLE 1257

Segment location on transcripts

| Transcript name | Segment starting position | Segment ending position |
|---|---|---|
| HUMOSTRO_PEA_1_PEA_1_T14 (SEQ ID NO: 141) | 1469 | 1504 |
| HUMOSTRO_PEA_1_PEA_1_T16 (SEQ ID NO: 142) | 1392 | 1427 |

Segment cluster HUMOSTRO_PEA_1_PEA_1_node_37 (SEQ ID NO:985) according to the present invention is supported by 295 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1258 below describes the starting and ending position of this segment on each transcript.

TABLE 1258

Segment location on transcripts

| Transcript name | Segment starting position | Segment ending position |
|---|---|---|
| HUMOSTRO_PEA_1_PEA_1_T14 (SEQ ID NO: 141) | 1505 | 1623 |
| HUMOSTRO_PEA_1_PEA_1_T16 (SEQ ID NO: 142) | 1428 | 1546 |

Segment cluster HUMOSTRO_PEA_1_PEA_1_node_38 (SEQ ID NO:986) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1259 below describes the starting and ending position of this segment on each transcript.

```
1    MPFRLLIPLGLLCALLPQHHGAPGPDGSAPDPAHYR    36
     ||||||||||||||||||||||||||||||||||||
1    MPFRLLIPLGLLCALLPQHHGAPGPDGSAPDPAHYR    36
```

Segment cluster HUMOSTRO_PEA_1_PEA_1_node_39 (SEQ ID NO:987) according to the present invention is supported by 268 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1260 below describes the starting and ending position of this segment on each transcript.

TABLE 1260

Segment location on transcripts

| Transcript name | Segment starting position | Segment ending position |
|---|---|---|
| HUMOSTRO_PEA_1_PEA_1_T14 (SEQ ID NO: 141) | 1635 | 1725 |
| HUMOSTRO_PEA_1_PEA_1_T16 (SEQ ID NO: 142) | 1558 | 1648 |

Segment cluster HUMOSTRO_PEA_1_PEA_1_node_40 (SEQ ID NO:988) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1261 below describes the starting and ending position of this segment on each transcript.

TABLE 1261

Segment location on transcripts

| Transcript name | Segment starting position | Segment ending position |
|---|---|---|
| HUMOSTRO_PEA_1_PEA_1_T14 (SEQ ID NO: 141) | 1726 | 1743 |
| HUMOSTRO_PEA_1_PEA_1_T16 (SEQ ID NO: 142) | 1649 | 1666 |

Segment cluster HUMOSTRO_PEA_1_PEA_1_node_41 (SEQ ID NO:989) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1262 below describes the starting and ending position of this segment on each transcript.

TABLE 1262

Segment location on transcripts

| Transcript name | Segment starting position | Segment ending position |
|---|---|---|
| HUMOSTRO_PEA_1_PEA_1_T14 (SEQ ID NO: 141) | 1744 | 1749 |
| HUMOSTRO_PEA_1_PEA_1_T16 (SEQ ID NO: 142) | 1667 | 1672 |

Segment cluster HUMOSTRO_PEA_1_PEA_1_node_42 (SEQ ID NO:990) according to the present invention is supported by 224 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1263 below describes the starting and ending position of this segment on each transcript.

TABLE 1263

Segment location on transcripts

| Transcript name | Segment starting position | Segment ending position |
|---|---|---|
| HUMOSTRO_PEA_1_PEA_1_T14 (SEQ ID NO: 141) | 1750 | 1809 |
| HUMOSTRO_PEA_1_PEA_1_T16 (SEQ ID NO: 142) | 1673 | 1732 |

Variant Protein Alignment to the Previously Known Protein:
Sequence name: OSTP_HUMAN (SEQ ID NO:1462)
Sequence documentation:
Alignment of: HUMOSTRO_PEA_1_PEA_1_P21 (SEQ ID NO:1627) x OSTP_HUMAN (SEQ ID NO:1462) ..
Alignment segment 1/1:

| | | | |
|---|---|---|---|
| Quality: | 578.00 | Escore: | 0 |
| Matching length: | 58 | Total length: | 58 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1    MRIAVICFCLLGITCAIPVKQADSGSSEEKQLYNKYPDAVATWLNPDPSQ    50
     ||||||||||||||||||||||||||||||||||||||||||||||||||
1    MRIAVICFCLLGITCAIPVKQADSGSSEEKQLYNKYPDAVATWLNPDPSQ    50

51   KQNLLAPQ    58
     ||||||||
51   KQNLLAPQ    58
```

Sequence name: OSTP_HUMAN (SEQ ID NO:1462)
Sequence documentation:
Alignment of: HUMOSTRO_PEA_1_PEA_1_P25 (SEQ ID NO:1628) x OSTP_HUMAN (SEQ ID NO:1462) ..

Alignment segment 1/1:

| | | | |
|---|---|---|---|
| Quality: | 301.00 | Escore: | 0 |
| Matching length: | 31 | Total length: | 31 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1  MRIAVICFCLLGITCAIPVKQADSGSSEEKQ  31
   |||||||||||||||||||||||||||||||
1  MRIAVICFCLLGITCAIPVKQADSGSSEEKQ  31
```

Sequence name: OSTP_HUMAN (SEQ ID NO:1462)
Sequence documentation:
Alignment of: HUMOSTRO_PEA_1_PEA_1_P30 (SEQ ID NO:1629) x OSTP_HUMAN (SEQ ID NO:1462) ..
Alignment segment 1/1:

| | | | |
|---|---|---|---|
| Quality: | 301.00 | Escore: | 0 |
| Matching length: | 31 | Total length: | 31 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1  MRIAVICFCLLGITCAIPVKQADSGSSEEKQ  31
   |||||||||||||||||||||||||||||||
1  MRIAVICFCLLGITCAIPVKQADSGSSEEKQ  31
```

Description for Cluster R11723

Cluster R11723 features 6 transcript(s) and 26 segment(s) of interest, the names for which are given in Tables 1264 and 1265, respectively, the sequences themselves are given at the end of the application. The selected protein variants are given in table 1266.

TABLE 1264

Transcripts of interest

| Transcript Name | Sequence ID No. |
|---|---|
| R11723_PEA_1_T15 | 144 |
| R11723_PEA_1_T17 | 145 |
| R11723_PEA_1_T19 | 146 |
| R11723_PEA_1_T20 | 147 |
| R11723_PEA_1_T5 | 148 |
| R11723_PEA_1_T6 | 149 |

TABLE 1265

Segments of interest

| Segment Name | Sequence ID No. |
|---|---|
| R11723_PEA_1_node_13 | 991 |
| R11723_PEA_1_node_16 | 992 |
| R11723_PEA_1_node_19 | 993 |
| R11723_PEA_1_node_2 | 994 |
| R11723_PEA_1_node_22 | 995 |
| R11723_PEA_1_node_31 | 996 |
| R11723_PEA_1_node_10 | 997 |
| R11723_PEA_1_node_11 | 998 |
| R11723_PEA_1_node_15 | 999 |
| R11723_PEA_1_node_18 | 1000 |
| R11723_PEA_1_node_20 | 1001 |
| R11723_PEA_1_node_21 | 1002 |
| R11723_PEA_1_node_23 | 1003 |
| R11723_PEA_1_node_24 | 1004 |
| R11723_PEA_1_node_25 | 1005 |
| R11723_PEA_1_node_26 | 1006 |
| R11723_PEA_1_node_27 | 1007 |
| R11723_PEA_1_node_28 | 1008 |
| R11723_PEA_1_node_29 | 1009 |
| R11723_PEA_1_node_3 | 1010 |
| R11723_PEA_1_node_30 | 1011 |
| R11723_PEA_1_node_4 | 1012 |
| R11723_PEA_1_node_5 | 1013 |
| R11723_PEA_1_node_6 | 1014 |
| R11723_PEA_1_node_7 | 1015 |
| R11723_PEA_1_node_8 | 1016 |

TABLE 1266

Proteins of interest

| Protein Name | Sequence ID No. |
|---|---|
| R11723_PEA_1_P2 | 1409 |
| R11723_PEA_1_P6 | 1410 |
| R11723_PEA_1_P7 | 1411 |
| R11723_PEA_1_P13 | 1412 |
| R11723_PEA_1_P10 | 1413 |

Cluster R11723 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 47 refer to weighted expression of ESTs in each category, as "parts per million" (ratio of the expression of ESTs for a particular cluster to the expression of all ESTs in that category, according to parts per million).

Figure 47:
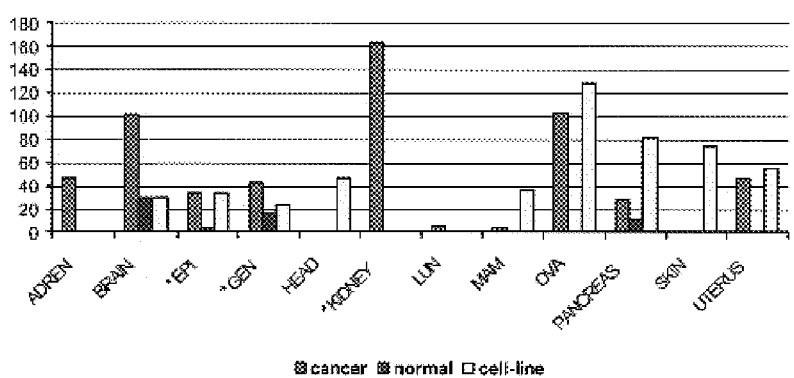
FIG. 47 is a histogram showing Cancer and cell-line vs. normal tissue expression for Cluster HUMOSTRO, demonstrating overexpression in epithelial malignant tumors, a mixture of malignant tumors from different tissues and kidney malignant tumors.

Overall, the following results were obtained as shown with regard to the histograms in FIG. 47 and Table 1267. This cluster is overexpressed (at least at a minimum level) in the following pathological conditions: epithelial malignant tumors, a mixture of malignant tumors from different tissues and kidney malignant tumors.

TABLE 1267

Normal tissue distribution

| Name of Tissue | Number |
|---|---|
| Adrenal | 0 |
| Brain | 30 |
| Epithelial | 3 |
| General | 17 |
| head and neck | 0 |
| Kidney | 0 |
| Lung | 0 |
| Breast | 0 |
| Ovary | 0 |
| Pancreas | 10 |
| Skin | 0 |
| Uterus | 0 |

TABLE 1268

P values and ratios for expression in cancerous tissue

| Name of Tissue | P1 | P2 | SP1 | R3 | SP2 | R4 |
|---|---|---|---|---|---|---|
| Adrenal | 4.2e−01 | 4.6e−01 | 4.6e−01 | 2.2 | 5.3e−01 | 1.9 |
| Brain | 2.2e−01 | 2.0e−01 | 1.2e−02 | 2.8 | 5.0e−02 | 2.0 |
| Epithelial | 3.0e−05 | 6.3e−05 | 1.8e−05 | 6.3 | 3.4e−06 | 6.4 |
| General | 7.2e−03 | 4.0e−02 | 1.3e−04 | 2.1 | 1.1e−03 | 1.7 |
| head and neck | 1 | 5.0e−01 | 1 | 1.0 | 7.5e−01 | 1.3 |
| Kidney | 1.5e−01 | 2.4e−01 | 4.4e−03 | 5.4 | 2.8e−02 | 3.6 |
| Lung | 1.2e−01 | 1.6e−01 | 1 | 1.6 | 1 | 1.3 |
| Breast | 5.9e−01 | 4.4e−01 | 1 | 1.1 | 6.8e−01 | 1.5 |
| Ovary | 1.6e−02 | 1.3e−02 | 1.0e−01 | 3.8 | 7.0e−02 | 3.5 |
| Pancreas | 5.5e−01 | 2.0e−01 | 3.9e−01 | 1.9 | 1.4e−01 | 2.7 |
| Skin | 1 | 4.4e−01 | 1 | 1.0 | 1.9e−02 | 2.1 |
| Uterus | 1.5e−02 | 5.4e−02 | 1.9e−01 | 3.1 | 1.4e−01 | 2.5 |

As noted above, contig R11723 features 6 transcript(s), which were listed in Table 1 above. A description of each variant protein according to the present invention is now provided.

Variant protein R11723_PEA_1_P2 (SEQ ID NO:1409) according to the present invention has an amino acid sequence as given at the end of the application; it is encoded by transcript(s) R11723_PEA_1_T6 (SEQ ID NO:149). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P2 (SEQ ID NO:1409) also has the following non-silent SNPs (Single Nucleotide Polymorphisms) as listed in Table 1269, (given according to their position(s) on the amino acid sequence, with the alternative amino acid(s) listed; the last column indicates whether the SNP is known or not; the presence of known SNPs in variant protein R11723_PEA_P2 (SEQ ID NO:1409) sequence provides support for the deduced sequence of this variant protein according to the present invention).

TABLE 1269

Amino acid mutations

| SNP position(s) on amino acid sequence | Alternative amino acid(s) | Previously known SNP? |
|---|---|---|
| 107 | H -> P | Yes |
| 70 | G -> | No |
| 70 | G -> C | No |

Variant protein R11723_PEA_1_P2 (SEQ ID NO:1409) is encoded by the following transcript(s): R11723_PEA_1_T6 (SEQ ID NO:149), for which the sequence(s) is/are given at the end of the application. The coding portion of transcript R11723_PEA_1_T6 (SEQ ID NO:149) is shown in bold; this coding portion starts at position 1716 and ends at position 2051. The transcript also has the following SNPs as listed in Table 1270 (given according to their position on the nucleotide sequence, with the alternative nucleic acid listed; the last column indicates whether the SNP is known or not; the presence of known SNPs in variant protein R11723_PEA_1_P2 (SEQ ID NO:1409) sequence provides support for the deduced sequence of this variant protein according to the present invention).

TABLE 1270

Nucleic acid SNPs

| SNP position on nucleotide sequence | Alternative nucleic acid | Previously known SNP? |
|---|---|---|
| 1231 | C -> T | Yes |
| 1278 | G -> C | Yes |
| 1923 | G -> | No |
| 1923 | G -> T | No |
| 2035 | A -> C | Yes |
| 2048 | A -> C | No |
| 2057 | A -> G | Yes |

Variant protein R11723_PEA_1_P6 (SEQ ID NO:1410) according to the present invention has an amino acid sequence as given at the end of the application; it is encoded by transcript(s) R11723_PEA_1_T15 (SEQ ID NO:144). One or more alignments to one or more previously published protein sequences are given at the end of the application. A brief description of the relationship of the variant protein according to the present invention to each such aligned protein is as follows:

Comparison Report Between R11723_PEA_1_P6 (SEQ ID NO:1410) and Q8IXM0 (SEQ ID NO:1707):

1. An isolated chimeric polypeptide encoding for R11723_PEA_1_P6 (SEQ ID NO:1410), comprising a first amino acid sequence being at least 70%, optionally at least 80%, preferably at least 85%, more preferably at least 90% and most preferably at least 95% homologous to a polypeptide having the sequence MWVLGIAATFCGLFLLPGFAL-QIQCYQCEEFQLNNDCSSPEFIVNCTVN-VQDMCQKEV MEQSAGIMYRKSCASSAACLIASAG-SPCRGLAPGREEQRALHKAGAVGGGVR (SEQ ID NO: 1741) corresponding to amino acids 1-110 of R11723_PEA_1_P6 (SEQ ID NO:1410), and a second amino acid sequence being at least 90% homologous to MYAQALLVVGV-LQRQAAAQHLHEHPPKLLRGHRVQERVD-DRAEVEKRLREGEEDHV RPEVGPRPVVLGFGRSHD-PPNLVGHPAYGQCHNNQPWADTSRRERQRKEKHS MRTQ corresponding to amino acids 1-112 of Q8IXM0

(SEQ ID NO:1707), which also corresponds to amino acids 111-222 of R11723_PEA_1_P6 (SEQ ID NO:1410), wherein said first and second amino acid sequences are contiguous and in a sequential order.

2. An isolated polypeptide encoding for a head of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence MWVLGIAATFCGLFLLPGFALQIQCYQ-CEEFQLNNDCSSPEFIVNCTVNVQDMCQKEV MEQSAGIMYRKSCASSAACLIASAG-SPCRGLAPGREEQRALHKAGAVGGGVR (SEQ ID NO:1741) of R11723_PEA_1_P6 (SEQ ID NO:1410).

Comparison Report Between R11723_PEA_1_P6 (SEQ ID NO:1410) and Q96AC2 (SEQ ID NO:1708):

1. An isolated chimeric polypeptide encoding for R11723_PEA_1_P6 (SEQ ID NO:1410) comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q96AC2 (SEQ ID NO:1708), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1742) corresponding to amino acids 84-222 of R11723_PEA_1_P6 (SEQ ID NO:1410), wherein said first and second amino acid sequences are contiguous and in a sequential order.

2. An isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1742) in R11723_PEA_1_P6 (SEQ ID NO:1410).

Comparison Report Between R11723_PEA_1_P6 (SEQ ID NO:1410) and Q8N2G4 (SEQ ID NO:1709):

1. An isolated chimeric polypeptide encoding for R11723_PEA_1_P6 (SEQ ID NO:1410), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q8N2G4 (SEQ ID NO:1709), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1742) corresponding to amino acids 84-222 of R11723_PEA_1_P6 (SEQ ID NO:1410), wherein said first and second amino acid sequences are contiguous and in a sequential order.

2. An isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1742) in R11723_PEA_1_P6 (SEQ ID NO:1410).

Comparison Report Between R11723_PEA_1_P6 (SEQ ID NO:1410) and BAC85518 (SEQ ID NO:1710):

1. An isolated chimeric polypeptide encoding for R11723_PEA_1_P6 (SEQ ID NO:1410), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 24-106 of BAC85518 (SEQ ID NO:1710), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1742) corresponding to amino acids 84-222 of R11723_PEA_1_P6 (SEQ ID NO:1410), wherein said first and second amino acid sequences are contiguous and in a sequential order.

2. An isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO:1742) in R11723_PEA_1_P6 (SEQ ID NO:1410).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P6 (SEQ ID NO:1410) also has the following non-silent SNPs (Single Nucleotide Polymorphisms) as listed in Table, (given according to their 1271 position(s) on the amino acid sequence, with the alternative amino acid(s) listed; the last column indicates whether the SNP is known or not; the presence of known SNPs in variant protein R11723_PEA_1_P6 (SEQ ID NO:1410)

sequence provides support for the deduced sequence of this variant protein according to the present invention).

TABLE 1271

Amino acid mutations

| SNP position(s) on amino acid sequence | Alternative amino acid(s) | Previously known SNP? |
|---|---|---|
| 180 | G -> | No |
| 180 | G -> C | No |
| 217 | H -> P | Yes |

Variant protein R11723_PEA_1_P6 (SEQ ID NO:1410) is encoded by the following transcript(s): R11723_PEA_1_T15 (SEQ ID NO:144), for which the sequence(s) is/are given at the end of the application. The coding portion of transcript R11723_PEA_1_T15 (SEQ ID NO:144) is shown in bold; this coding portion starts at position 434 and ends at position 1099. The transcript also has the following SNPs as listed in Table 1272 (given according to their position on the nucleotide sequence, with the alternative nucleic acid listed; the last column indicates whether the SNP is known or not; the presence of known SNPs in variant protein R11723_PEA_1_P6 (SEQ ID NO:1410) sequence provides support for the deduced sequence of this variant protein according to the present invention).

TABLE 1272

Nucleic acid SNPs

| SNP position on nucleotide sequence | Alternative nucleic acid | Previously known SNP? |
|---|---|---|
| 971 | G -> | No |
| 971 | G -> T | No |
| 1083 | A -> C | Yes |
| 1096 | A -> C | No |
| 1105 | A -> G | Yes |

Variant protein R11723_PEA_1_P7 (SEQ ID NO:1411) according to the present invention has an amino acid sequence as given at the end of the application; it is encoded by transcript(s) R11723_PEA_1_T17 (SEQ ID NO:145). One or more alignments to one or more previously published protein sequences are given at the end of the application. A brief description of the relationship of the variant protein according to the present invention to each such aligned protein is as follows:

Comparison Report Between R11723_PEA_1_P7 (SEQ ID NO:1411) and Q96AC2 (SEQ ID NO:1708):

1. An isolated chimeric polypeptide encoding for R11723_PEA_1_P7 (SEQ ID NO:1411) comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q96AC2 (SEQ ID NO:1708), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO:1743) corresponding to amino acids 65-93 of R11723_PEA_1_P7 (SEQ ID NO:1411), wherein said first and second amino acid sequences are contiguous and in a sequential order.

2. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1743) in R11723_PEA_1_P7 (SEQ ID NO:1411).

Comparison Report Between R11723_PEA_1_P7 (SEQ ID NO:1411) and Q8N2G4 (SEQ ID NO:1709):

1. An isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q8N2G4 (SEQ ID NO:1709), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO:1743) corresponding to amino acids 65-93 of R11723_PEA_1_P7 (SEQ ID NO:1411), wherein said first and second amino acid sequences are contiguous and in a sequential order.

2. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1743) in R11723_PEA_1_P7 (SEQ ID NO:1411).

Comparison Report Between R11723_PEA_1_P7 (SEQ ID NO:1411) and BAC85273:

1. An isolated chimeric polypeptide encoding for R11723_PEA_1_P7 (SEQ ID NO:1411), comprising a first amino acid sequence being at least 70%, optionally at least 80%, preferably at least 85%, more preferably at least 90% and most preferably at least 95% homologous to a polypeptide having the sequence MWVLG (SEQ ID NO:1744) corresponding to amino acids 1-5 of R11723_PEA_1_P7 (SEQ ID NO:1411), second amino acid sequence being at least 90% homologous to IAATFCGLFLLPGFALQIQCYQ-CEEFQLNNDCSSPEFIVNCTVNVQDMC-QKEVMEQSAG corresponding to amino acids 22-80 of BAC85273, which also corresponds to amino acids 6-64 of R11723_PEA_1_P7 (SEQ ID NO:1411), and a third amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO:1743) corresponding to amino acids 65-93 of R11723_PEA_1_P7 (SEQ ID NO:1411), wherein said first, second and third amino acid sequences are contiguous and in a sequential order.

2. An isolated polypeptide encoding for a head of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence MWVLG (SEQ ID NO:1744) of R11723_PEA_1_P7 (SEQ ID NO:1411).

3. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1743) in R11723_PEA_1_P7 (SEQ ID NO:1411).

Comparison Report Between R11723_PEA_1_P7 (SEQ ID NO:1411) and BAC85518 (SEQ ID NO:1710):

1. An isolated chimeric polypeptide encoding for R11723_PEA_1_P7 (SEQ ID NO:1411) comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 24-87 of BAC85518 (SEQ ID NO:1710), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTRLECSGTISAH-CNLCLPGSNDHPT (SEQ ID NO:1743) corresponding to amino acids 65-93 of R11723_PEA_1_P7 (SEQ ID NO:1411), wherein said first and second amino acid sequences are contiguous and in a sequential order.

2. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1743) in R11723_PEA_1_P7 (SEQ ID NO:1411).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P7 (SEQ ID NO:1411) also has the following non-silent SNPs (Single Nucleotide Polymorphisms) as listed in Table 1273, (given according to their position(s) on the amino acid sequence, with the alternative amino acid(s) listed; the last column indicates whether the SNP is known or not; the presence of known SNPs in variant protein R11723_PEA_1_P7 (SEQ ID NO:1411) sequence provides support for the deduced sequence of this variant protein according to the present invention).

TABLE 1273

Amino acid mutations

| SNP position(s) on amino acid sequence | Alternative amino acid(s) | Previously known SNP? |
|---|---|---|
| 67 | C -> S | Yes |

Variant protein R11723_PEA_1_P7 (SEQ ID NO:1411) is encoded by the following transcript(s): R11723_PEA_1_T17 (SEQ ID NO:145), for which the sequence(s) is/are given at the end of the application. The coding portion of transcript R11723_PEA_1_T17 (SEQ ID NO:145) is shown in bold; this coding portion starts at position 434 and ends at position 712. The transcript also has the following SNPs as listed in Table 1274 (given according to their position on the nucleotide sequence, with the alternative nucleic acid listed; the last column indicates whether the SNP is known or not; the presence of known SNPs in variant protein R11723_PEA_1_P7 (SEQ ID NO:1411) sequence provides support for the deduced sequence of this variant protein according to the present invention).

TABLE 1274

Nucleic acid SNPs

| SNP position on nucleotide sequence | Alternative nucleic acid | Previously known SNP? |
|---|---|---|
| 625 | G -> T | Yes |
| 633 | G -> C | Yes |
| 1303 | C -> T | Yes |

Variant protein R11723_PEA_1_P13 (SEQ ID NO:1412) according to the present invention has an amino acid sequence as given at the end of the application; it is encoded by transcript(s) R11723_PEA_1_T19 (SEQ ID NO:146). One or more alignments to one or more previously published protein sequences are given at the end of the application. A brief description of the relationship of the variant protein according to the present invention to each such aligned protein is as follows:

Comparison Report Between R11723_PEA_1_P13 (SEQ ID NO:1412) and Q96AC2 (SEQ ID NO:1708):

1. An isolated chimeric polypeptide encoding for R11723_PEA_1_P13 (SEQ ID NO:1412), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO:1708), which also corresponds to amino acids 1-63 of R11723_PEA_1_P13 (SEQ ID NO:1412), and a second amino acid sequence being at least 70%, optionally at least 80%, preferably at least 85%, more preferably at least 90% and most preferably at least 95% homologous to a polypeptide having the sequence DTKRTNTLLFEM-RHFAKQLTT (SEQ ID NO:1745) corresponding to amino acids 64-84 of R11723_PEA_1_P13 (SEQ ID NO:1412), wherein said first and second amino acid sequences are contiguous and in a sequential order.

2. An isolated polypeptide encoding for a tail of R11723_PEA_1_P13 (SEQ ID NO:1412), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO:1745) in R11723_PEA_1_P13 (SEQ ID NO:1412).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P13 (SEQ ID NO:1412) is encoded by the following transcript(s): R11723_PEA_1_T19 (SEQ ID NO:146) and R11723_PEA_1_T5 (SEQ ID NO:148), for which the sequence(s) is/are given at the end of the application. The coding portion of transcript R11723_PEA_1_T19 (SEQ ID NO:146) is shown in bold;

this coding portion starts at position 434 and ends at position 685. The transcript also has the following SNPs as listed in Table 1275 (given according to their position on the nucleotide sequence, with the alternative nucleic acid listed; the last column indicates whether the SNP is known or not; the presence of known SNPs in variant protein R11723_PEA_1_P13 (SEQ ID NO:1412) sequence provides support for the deduced sequence of this variant protein according to the present invention).

TABLE 1275

Nucleic acid SNPs

| SNP position on nucleotide sequence | Alternative nucleic acid | Previously known SNP? |
|---|---|---|
| 778 | G -> T | Yes |
| 786 | G -> C | Yes |
| 1456 | C -> T | Yes |

Variant protein R11723_PEA_1_P10 (SEQ ID NO:1413) according to the present invention has an amino acid sequence as given at the end of the application; it is encoded by transcript(s) R11723_PEA_1_T20 (SEQ ID NO:147). One or more alignments to one or more previously published protein sequences are given at the end of the application. A brief description of the relationship of the variant protein according to the present invention to each such aligned protein is as follows:

Comparison Report Between R11723_PEA_1_P10 (SEQ ID NO:1413) and Q96AC2 (SEQ ID NO:1708):

1. An isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2 (SEQ ID NO:1708), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO:1746) corresponding to amino acids 64-90 of R11723_PEA_1_P10 (SEQ ID NO:1413), wherein said first and second amino acid sequences are contiguous and in a sequential order.

2. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

Comparison Report Between R11723_PEA_1_P10 (SEQ ID NO:1413) and Q8N2G4 (SEQ ID NO:1709):

1. An isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q8N2G4 (SEQ ID NO:1709), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO:1746) corresponding to amino acids 64-90 of R11723_PEA_1_P10 (SEQ ID NO:1413), wherein said first and second amino acid sequences are contiguous and in a sequential order.

2. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

Comparison Report Between R11723_PEA_1_P10 (SEQ ID NO:1413) and BAC85273:

1. An isolated chimeric polypeptide encoding for R11723_PEA_1_P10 (SEQ ID NO:1413), comprising a first amino acid sequence being at least 70%, optionally at least 80%, preferably at least 85%, more preferably at least 90% and most preferably at least 95% homologous to a polypeptide having the sequence MWVLG (SEQ ID NO:1744) corresponding to amino acids 1-5 of R11723_PEA_1_P10 (SEQ ID NO:1413), second amino acid sequence being at least 90% homologous to IAATFCGLFLLPGFALQIQCYQ-CEEFQLNNDCSSPEFIVNCTVNVQDMCQKEVMEQSA corresponding to amino acids 22-79 of BAC85273, which also corresponds to amino acids 6-63 of R11723_PEA_1_P10 (SEQ ID NO:1413), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO:1746) corresponding to amino acids 64-90 of R11723_PEA_1_P10 (SEQ ID NO:1413), wherein said first, second and third amino acid sequences are contiguous and in a sequential order.

2. An isolated polypeptide encoding for a head of R11723 PEA_1_P10 (SEQ ID NO:1413), comprising a polypeptide being at least 70%, optionally at least about 80%, preferably at least about 85%, more preferably at least about 90% and most preferably at least about 95% homologous to the sequence MWVLG (SEQ ID NO:1744) of R11723_PEA_1_P10 (SEQ ID NO:1413).

3. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

Comparison Report Between R11723_PEA_1_P10 (SEQ ID NO:1413) and BAC85518 (SEQ ID NO:1710):

1. An isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 24-86 of BAC85518 (SEQ ID NO:1710), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNN-FSTLQPLPPRLK (SEQ ID NO:1746) corresponding to amino acids 64-90 of R11723_PEA_1_P10 (SEQ ID NO:1413), wherein said first and second amino acid sequences are contiguous and in a sequential order.

2. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R111723_PEA_1_P10 (SEQ ID NO:1413).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P10 (SEQ ID NO:1413) also has the following non-silent SNPs (Single Nucleotide Polymorphisms) as listed in Table 1276, (given according to their position(s) on the amino acid sequence, with the alternative amino acid(s) listed; the last column indicates whether the SNP is known or not; the presence of known SNPs in variant protein R11723_PEA_1_P10 (SEQ ID NO:1413) sequence provides support for the deduced sequence of this variant protein according to the present invention).

TABLE 1276

Amino acid mutations

| SNP position(s) on amino acid sequence | Alternative amino acid(s) | Previously known SNP? |
|---|---|---|
| 66 | V -> F | Yes |

Variant protein R11723_PEA_1_P10 (SEQ ID NO:1413) is encoded by the following transcript(s): R11723_PEA_1_T20 (SEQ ID NO:147), for which the sequence(s) is/are given at the end of the application. The coding portion of transcript R11723_PEA_1_T20 (SEQ ID NO:147) is shown in bold; this coding portion starts at position 434 and ends at position 703. The transcript also has the following SNPs as listed in Table 1277 (given according to their position on the nucleotide sequence, with the alternative nucleic acid listed; the last column indicates whether the SNP is known or not; the presence of known SNPs in variant protein R11723_PEA_1_P10 (SEQ ID NO:1413) sequence provides support for the deduced sequence of this variant protein according to the present invention).

TABLE 1277

Nucleic acid SNPs

| SNP position on nucleotide sequence | Alternative nucleic acid | Previously known SNP? |
|---|---|---|
| 629 | G -> T | Yes |
| 637 | G -> C | Yes |
| 1307 | C -> T | Yes |

As noted above, cluster R11723 features 26 segment(s), which were listed in Table 2 above and for which the sequence (s) are given at the end of the application. These segment(s) are portions of nucleic acid sequence(s) which are described herein separately because they are of particular interest. A description of each segment according to the present invention is now provided.

Segment cluster R11723_PEA_1_node_13 (SEQ ID NO:991) according to the present invention is supported by 5 libraries. The number of libraries was determined as previously described. This segment can be found in the following transcript(s): R11723_PEA_1_T19 (SEQ ID NO:146), R11723_PEA_1_T5 (SEQ ID NO:148) and R11723_PEA_1_T6 (SEQ ID NO:149). Table 1278 below describes the starting and ending position of this segment on each transcript.

TABLE 1278

Segment location on transcripts

| Transcript name | Segment starting position | Segment ending position |
|---|---|---|
| R11723_PEA_1_T19 (SEQ ID NO: 146) | 624 | 776 |
| R11723_PEA_1_T5 (SEQ ID NO: 148) | 624 | 776 |
| R11723_PEA_1_T6 (SEQ ID NO: 149) | 658 | 810 |

Segment cluster R11723_PEA_1_node_16 (SEQ ID NO:992) according to the present invention is supported by 3 libraries. The number of libraries was determined as previously described. This segment can be found in the following transcript(s): R11723_PEA_1_T17 (SEQ ID NO:145), R11723_PEA_1_T19 (SEQ ID NO:146) and R11723_PEA_1_T20 (SEQ ID NO:147). Table 1279 below describes the starting and ending position of this segment on each transcript.

TABLE 1279

Segment location on transcripts

| Transcript name | Segment starting position | Segment ending position |
|---|---|---|
| R11723_PEA_1_T17 (SEQ ID NO: 145) | 624 | 1367 |
| R11723_PEA_1_T19 (SEQ ID NO: 146) | 777 | 1520 |
| R11723_PEA_1_T20 (SEQ ID NO: 147) | 628 | 1371 |

Segment cluster R11723_PEA_1_node_19 (SEQ ID NO:993) according to the present invention is supported by 45 libraries. The number of libraries was determined as previously described. This segment can be found in the following transcript(s): R11723_PEA_1_T5 (SEQ ID NO:148) and R11723_PEA_1_T6 (SEQ ID NO:149). Table 1280 below describes the starting and ending position of this segment on each transcript.

TABLE 1280

Segment location on transcripts

| Transcript name | Segment starting position | Segment ending position |
|---|---|---|
| R11723_PEA_1_T5 (SEQ ID NO: 148) | 835 | 1008 |
| R11723_PEA_1_T6 (SEQ ID NO: 149) | 869 | 1042 |

Segment cluster R11723_PEA_1_node_2 (SEQ ID NO:994) according to the present invention is supported by 29 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1281 below describes the starting and ending position of this segment on each transcript.

TABLE 1281

Segment location on transcripts

| Transcript name | Segment starting position | Segment ending position |
| --- | --- | --- |
| R11723_PEA_1_T15 (SEQ ID NO: 144) | 1 | 309 |
| R11723_PEA_1_T17 (SEQ ID NO: 145) | 1 | 309 |
| R11723_PEA_1_T19 (SEQ ID NO: 146) | 1 | 309 |
| R11723_PEA_1_T20 (SEQ ID NO: 147) | 1 | 309 |
| R11723_PEA_1_T5 (SEQ ID NO: 148) | 1 | 309 |
| R11723_PEA_1_T6 (SEQ ID NO: 149) | 1 | 309 |

Segment cluster R11723_PEA_1_node_22 (SEQ ID NO:995) according to the present invention is supported by 65 libraries. The number of libraries was determined as previously described. This segment can be found in the following transcript(s): R11723_PEA_1_T5 (SEQ ID NO:148) and R11723_PEA_1_T6 (SEQ ID NO:149). Table 1282 below describes the starting and ending position of this segment on each transcript.

TABLE 1282

Segment location on transcripts

| Transcript name | Segment starting position | Segment ending position |
| --- | --- | --- |
| R11723_PEA_1_T5 (SEQ ID NO: 148) | 1083 | 1569 |
| R11723_PEA_1_T6 (SEQ ID NO: 149) | 1117 | 1603 |

Segment cluster R11723_PEA_1_node_31 (SEQ ID NO:996) according to the present invention is supported by 70 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1283 below describes the starting and ending position of this segment on each transcript (it should be noted that these transcripts show alternative polyadenylation).

TABLE 1283

Segment location on transcripts

| Transcript name | Segment starting position | Segment ending position |
| --- | --- | --- |
| R11723_PEA_1_T15 (SEQ ID NO: 144) | 1060 | 1295 |
| R11723_PEA_1_T5 (SEQ ID NO: 148) | 1978 | 2213 |
| R11723_PEA_1_T6 (SEQ ID NO: 149) | 2012 | 2247 |

According to an optional embodiment of the present invention, short segments related to the above cluster are also provided. These segments are up to about 120 bp in length, and so are included in a separate description. Segment cluster R11723_PEA_1_node_10 (SEQ ID NO:997) according to the present invention is supported by 38 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1284 below describes the starting and ending position of this segment on each transcript.

TABLE 1284

Segment location on transcripts

| Transcript name | Segment starting position | Segment ending position |
| --- | --- | --- |
| R11723_PEA_1_T15 (SEQ ID NO: 144) | 486 | 529 |
| R11723_PEA_1_T17 (SEQ ID NO: 145) | 486 | 529 |
| R11723_PEA_1_T19 (SEQ ID NO: 146) | 486 | 529 |
| R11723_PEA_1_T20 (SEQ ID NO: 147) | 486 | 529 |
| R11723_PEA_1_T5 (SEQ ID NO: 148) | 486 | 529 |
| R11723_PEA_1_T6 (SEQ ID NO: 149) | 520 | 563 |

Segment cluster R11723_PEA_1_node_11 (SEQ ID NO:998) according to the present invention is supported by 42 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1285 below describes the starting and ending position of this segment on each transcript.

TABLE 1285

Segment location on transcripts

| Transcript name | Segment starting position | Segment ending position |
| --- | --- | --- |
| R11723_PEA_1_T15 (SEQ ID NO: 144) | 530 | 623 |
| R11723_PEA_1_T17 (SEQ ID NO: 145) | 530 | 623 |
| R11723_PEA_1_T19 (SEQ ID NO: 146) | 530 | 623 |

TABLE 1285-continued

Segment location on transcripts

| Transcript name | Segment starting position | Segment ending position |
|---|---|---|
| R11723_PEA_1_T20 (SEQ ID NO: 147) | 530 | 623 |
| R11723_PEA_1_T5 (SEQ ID NO: 148) | 530 | 623 |
| R11723_PEA_1_T6 (SEQ ID NO: 149) | 564 | 657 |

Segment cluster R11723_PEA_1_node_15 (SEQ ID NO:999) according to the present invention can be found in the following transcript(s): R11723_PEA_1_T20 (SEQ ID NO:147). Table 1286 below describes the starting and ending position of this segment on each transcript.

TABLE 1286

Segment location on transcripts

| Transcript name | Segment starting position | Segment ending position |
|---|---|---|
| R11723_PEA_1_T20 (SEQ ID NO: 147) | 624 | 627 |

Segment cluster R11723_PEA_1_node_18 (SEQ ID NO:1000) according to the present invention is supported by 40 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1287 below describes the starting and ending position of this segment on each transcript.

TABLE 1287

Segment location on transcripts

| Transcript name | Segment starting position | Segment ending position |
|---|---|---|
| R11723_PEA_1_T15 (SEQ ID NO: 144) | 624 | 681 |
| R11723_PEA_1_T5 (SEQ ID NO: 148) | 777 | 834 |
| R11723_PEA_1_T6 (SEQ ID NO: 149) | 811 | 868 |

Segment cluster R11723_PEA_1_node_20 (SEQ ID NO:1001) according to the present invention can be found in the following transcript(s): R11723_PEA_1_T5 (SEQ ID NO:148) and R11723_PEA_1_T6 (SEQ ID NO:149). Table 1288 below describes the starting and ending position of this segment on each transcript.

TABLE 1288

Segment location on transcripts

| Transcript name | Segment starting position | Segment ending position |
|---|---|---|
| R11723_PEA_1_T5 (SEQ ID NO: 148) | 1009 | 1019 |
| R11723_PEA_1_T6 (SEQ ID NO: 149) | 1043 | 1053 |

Segment cluster R11723_PEA_1_node_21 (SEQ ID NO:1002) according to the present invention is supported by 36 libraries. The number of libraries was determined as previously described. This segment can be found in the following transcript(s): R11723_PEA_1_T5 (SEQ ID NO:148) and R11723_PEA_1_T6 (SEQ ID NO:149). Table 1289 below describes the starting and ending position of this segment on each transcript.

TABLE 1289

Segment location on transcripts

| Transcript name | Segment starting position | Segment ending position |
|---|---|---|
| R11723_PEA_1_T5 (SEQ ID NO: 148) | 1020 | 1082 |
| R11723_PEA_1_T6 (SEQ ID NO: 149) | 1054 | 1116 |

Segment cluster R11723_PEA_1_node_23 (SEQ ID NO:1003) according to the present invention is supported by 39 libraries. The number of libraries was determined as previously described. This segment can be found in the following transcript(s): R11723_PEA_1_T5 (SEQ ID NO:148) and R11723_PEA_1_T6 (SEQ ID NO:149). Table 1290 below describes the starting and ending position of this segment on each transcript.

TABLE 1290

Segment location on transcripts

| Transcript name | Segment starting position | Segment ending position |
|---|---|---|
| R11723_PEA_1_T5 (SEQ ID NO: 148) | 1570 | 1599 |
| R11723_PEA_1_T6 (SEQ ID NO: 149) | 1604 | 1633 |

Segment cluster R11723_PEA_1_node_24 (SEQ ID NO:1004) according to the present invention is supported by 51 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1291 below describes the starting and ending position of this segment on each transcript.

TABLE 1291

Segment location on transcripts

| Transcript name | Segment starting position | Segment ending position |
|---|---|---|
| R11723_PEA_1_T15 (SEQ ID NO: 144) | 682 | 765 |
| R11723_PEA_1_T5 (SEQ ID NO: 148) | 1600 | 1683 |
| R11723_PEA_1_T6 (SEQ ID NO: 149) | 1634 | 1717 |

Segment cluster R11723_PEA_1_node_25 (SEQ ID NO:1005) according to the present invention is supported by 54 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_

1_T6 (SEQ ID NO:149). Table 1292 below describes the starting and ending position of this segment on each transcript.

TABLE 1292

Segment location on transcripts

| Transcript name | Segment starting position | Segment ending position |
|---|---|---|
| R11723_PEA_1_T15 (SEQ ID NO: 144) | 766 | 791 |
| R11723_PEA_1_T5 (SEQ ID NO: 148) | 1684 | 1709 |
| R11723_PEA_1_T6 (SEQ ID NO: 149) | 1718 | 1743 |

Segment cluster R11723_PEA_1_node_26 (SEQ ID NO:1006) according to the present invention is supported by 62 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1293 below describes the starting and ending position of this segment on each transcript.

TABLE 1293

Segment location on transcripts

| Transcript name | Segment starting position | Segment ending position |
|---|---|---|
| R11723_PEA_1_T15 (SEQ ID NO: 144) | 792 | 904 |
| R11723_PEA_1_T5 (SEQ ID NO: 148) | 1710 | 1822 |
| R11723_PEA_1_T6 (SEQ ID NO: 149) | 1744 | 1856 |

Segment cluster R11723_PEA_1_node_27 (SEQ ID NO:1007) according to the present invention is supported by 67 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1294 below describes the starting and ending position of this segment on each transcript.

TABLE 1294

Segment location on transcripts

| Transcript name | Segment starting position | Segment ending position |
|---|---|---|
| R11723_PEA_1_T15 (SEQ ID NO: 144) | 905 | 986 |
| R11723_PEA_1_T5 (SEQ ID NO: 148) | 1823 | 1904 |
| R11723_PEA_1_T6 (SEQ ID NO: 149) | 1857 | 1938 |

Segment cluster R11723_PEA_1_node_28 (SEQ ID NO:1008) according to the present invention can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1295 below describes the starting and ending position of this segment on each transcript.

TABLE 1295

Segment location on transcripts

| Transcript name | Segment starting position | Segment ending position |
|---|---|---|
| R11723_PEA_1_T15 (SEQ ID NO: 144) | 987 | 1010 |
| R11723_PEA_1_T5 (SEQ ID NO: 148) | 1905 | 1928 |
| R11723_PEA_1_T6 (SEQ ID NO: 149) | 1939 | 1962 |

Segment cluster R11723_PEA_1_node_29 (SEQ ID NO:1009) according to the present invention is supported by 69 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1296 below describes the starting and ending position of this segment on each transcript.

TABLE 1296

Segment location on transcripts

| Transcript name | Segment starting position | Segment ending position |
|---|---|---|
| R11723_PEA_1_T15 (SEQ ID NO: 144) | 1011 | 1038 |
| R11723_PEA_1_T5 (SEQ ID NO: 148) | 1929 | 1956 |
| R11723_PEA_1_T6 (SEQ ID NO: 149) | 1963 | 1990 |

Segment cluster R11723_PEA_1_node_3 (SEQ ID NO:1010) according to the present invention can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1297 below describes the starting and ending position of this segment on each transcript.

TABLE 1297

Segment location on transcripts

| Transcript name | Segment starting position | Segment ending position |
|---|---|---|
| R11723_PEA_1_T15 (SEQ ID NO: 144) | 310 | 319 |
| R11723_PEA_1_T17 (SEQ ID NO: 145) | 310 | 319 |
| R11723_PEA_1_T19 (SEQ ID NO: 146) | 310 | 319 |
| R11723_PEA_1_T20 (SEQ ID NO: 147) | 310 | 319 |
| R11723_PEA_1_T5 (SEQ ID NO: 148) | 310 | 319 |
| R11723_PEA_1_T6 (SEQ ID NO: 149) | 310 | 319 |

Segment cluster R11723_PEA_1_node_30 (SEQ ID NO:1011) according to the present invention can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1298 below describes the starting and ending position of this segment on each transcript.

TABLE 1298

Segment location on transcripts

| Transcript name | Segment starting position | Segment ending position |
|---|---|---|
| R11723_PEA_1_T15 (SEQ ID NO: 144) | 1039 | 1059 |
| R11723_PEA_1_T5 (SEQ ID NO: 148) | 1957 | 1977 |
| R11723_PEA_1_T6 (SEQ ID NO: 149) | 1991 | 2011 |

Segment cluster R11723_PEA_1_node_4 (SEQ ID NO:1012) according to the present invention is supported by 25 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1299 below describes the starting and ending position of this segment on each transcript.

TABLE 1299

Segment location on transcripts

| Transcript name | Segment starting position | Segment ending position |
|---|---|---|
| R11723_PEA_1_T15 (SEQ ID NO: 144) | 320 | 371 |
| R11723_PEA_1_T17 (SEQ ID NO: 145) | 320 | 371 |
| R11723_PEA_1_T19 (SEQ ID NO: 146) | 320 | 371 |
| R11723_PEA_1_T20 (SEQ ID NO: 147) | 320 | 371 |
| R11723_PEA_1_T5 (SEQ ID NO: 148) | 320 | 371 |
| R11723_PEA_1_T6 (SEQ ID NO: 149) | 320 | 371 |

Segment cluster R11723_PEA_1_node_5 (SEQ ID NO:1013) according to the present invention is supported by 26 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1300 below describes the starting and ending position of this segment on each transcript.

TABLE 1300

Segment location on transcripts

| Transcript name | Segment starting position | Segment ending position |
|---|---|---|
| R11723_PEA_1_T15 (SEQ ID NO: 144) | 372 | 414 |
| R11723_PEA_1_T17 (SEQ ID NO: 145) | 372 | 414 |
| R11723_PEA_1_T19 (SEQ ID NO: 146) | 372 | 414 |
| R11723_PEA_1_T20 (SEQ ID NO: 147) | 372 | 414 |
| R11723_PEA_1_T5 (SEQ ID NO: 148) | 372 | 414 |
| R11723_PEA_1_T6 (SEQ ID NO: 149) | 372 | 414 |

Segment cluster R11723_PEA_1_node_6 (SEQ ID NO:1014) according to the present invention is supported by 27 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1301 below describes the starting and ending position of this segment on each transcript.

TABLE 1301

Segment location on transcripts

| Transcript name | Segment starting position | Segment ending position |
|---|---|---|
| R11723_PEA_1_T15 (SEQ ID NO: 144) | 415 | 446 |
| R11723_PEA_1_T17 (SEQ ID NO: 145) | 415 | 446 |
| R11723_PEA_1_T19 (SEQ ID NO: 146) | 415 | 446 |
| R11723_PEA_1_T20 (SEQ ID NO: 147) | 415 | 446 |
| R11723_PEA_1_T5 (SEQ ID NO: 148) | 415 | 446 |
| R11723_PEA_1_T6 (SEQ ID NO: 149) | 415 | 446 |

Segment cluster R11723_PEA_1_node_7 (SEQ ID NO:1015) according to the present invention is supported by 29 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1302 below describes the starting and ending position of this segment on each transcript.

TABLE 1302

Segment location on transcripts

| Transcript name | Segment starting position | Segment ending position |
|---|---|---|
| R11723_PEA_1_T15 (SEQ ID NO: 144) | 447 | 485 |
| R11723_PEA_1_T17 (SEQ ID NO: 145) | 447 | 485 |
| R11723_PEA_1_T19 (SEQ ID NO: 146) | 447 | 485 |
| R11723_PEA_1_T20 (SEQ ID NO: 147) | 447 | 485 |
| R11723_PEA_1_T5 (SEQ ID NO: 148) | 447 | 485 |
| R11723_PEA_1_T6 (SEQ ID NO: 149) | 447 | 485 |

Segment cluster R11723_PEA_1_node_8 (SEQ ID NO:1016) according to the present invention is supported by 2 libraries. The number of libraries was determined as previously described. This segment can be found in the following transcript(s): R11723_PEA_1_T6 (SEQ ID NO:149). Table 1303 below describes the starting and ending position of this segment on each transcript.

TABLE 1303

Segment location on transcripts

| Transcript name | Segment starting position | Segment ending position |
|---|---|---|
| R11723_PEA_1_T6 (SEQ ID NO: 149) | 486 | 519 |

Variant Protein Alignment to the Previously Known Protein:

Sequence name: /tmp/gp6eQTLWqk/mFtjUpUzhb:Q8IXM0 (SEQ ID NO:1707)

Sequence documentation:

Alignment of: R11723_PEA_1_P6 (SEQ ID NO:1410) x Q8IXM0 (SEQ ID NO:1707) ..

Alignment segment 1/1:

| Quality: | 1128.00 | Escore: | 0 |
|---|---|---|---|
| Matching length: | 112 | Total length: | 112 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
111  MYAQALLVVGVLQRQAAAQHLHEHPPKLLRGHRVQERVDDRAEVEKRLRE  160
     |||||||||||||||||||||||||||||||||||||||||||||||||
  1  MYAQALLVVGVLQRQAAAQHLHEHPPKLLRGHRVQERVDDRAEVEKRLRE   50

161  GEEDHVRPEVGPRPVVLGFGRSHDPPNLVGHPAYGQCHNNQPWADTSRRE  210
     |||||||||||||||||||||||||||||||||||||||||||||||||
 51  GEEDHVRPEVGPRPVVLGFGRSHDPPNLVGHPAYGQCHNNQPWADTSRRE  100

211  RQRKEKHSMRTQ  222
     ||||||||||||
101  RQRKEKHSMRTQ  112
```

Sequence name: /tmp/gp6eQTLWqk/mFtjUpUzhb:Q96AC2
(SEQ ID NO:1708)
Sequence documentation:
Alignment of: R11723_PEA_1_P6 (SEQ ID NO:1410) x
Q96AC2 (SEQ ID NO:1708) ..
Alignment segment 1/1:

| Quality: | 835.00 | Escore: | 0 |
|---|---|---|---|
| Matching length: | 83 | Total length: | 83 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAGIMYRKSCASSAACLIASAG                   83
    |||||||||||||||||||||||||||||||||
51  QDMCQKEVMEQSAGIMYRKSCASSAACLIASAG                   83
```

Sequence name: /tmp/gp6eQTLWqk/mFtjUpUzhb:Q8N2G4
(SEQ ID NO:1709)
Sequence documentation:
Alignment of: R11723_PEA_1_P6 (SEQ ID NO:1410) x
Q8N2G4 (SEQ ID NO:1709) ..
Alignment segment 1/1:

| Quality: | 835.00 | Escore: | 0 |
|---|---|---|---|
| Matching length: | 83 | Total length: | 83 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAGIMYRKSCASSAACLIASAG                   83
    |||||||||||||||||||||||||||||||||
51  QDMCQKEVMEQSAGIMYRKSCASSAACLIASAG                   83
```

Sequence name: /tmp/gp6eQTLWqk/mFtjUpUzhb: BAC85518 (SEQ ID NO:1710)
Sequence documentation:
Alignment of: R11723_PEA_1_P6 (SEQ ID NO:1410) x BAC85518 (SEQ ID NO:1710) ..
Alignment segment 1/1:

| Quality: | 835.00 | Escore: | 0 |
|---|---|---|---|
| Matching length: | 83 | Total length: | 83 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
24  MWVLGIAATFCGLFLLPGFALQIQCYQCEEFQLNNDCSSPEFIVNCTVNV  73

51  QDMCQKEVMEQSAGIMYRKSCASSAACLIASAG  83
    |||||||||||||||||||||||||||||||||
74  QDMCQKEVMEQSAGIMYRKSCASSAACLIASAG  106
```

Sequence name: /tmp/VXjdFlzdBX/bexTxTh0Th:Q96AC2 (SEQ ID NO:1708)
Sequence documentation:
Alignment of: R11723_PEA_1_P7 (SEQ ID NO:1411) x Q96AC2 (SEQ ID NO:1708) ..
Alignment segment 1/1:

| Quality: | 654.00 | Escore: | 0 |
|---|---|---|---|
| Matching length: | 64 | Total length: | 64 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAG  64
    ||||||||||||||
51  QDMCQKEVMEQSAG  64
```

Sequence name: /tmp/VXjdFlzdBX/bexTxTh0Th:Q8N2G4 (SEQ ID NO:1709)
Sequence documentation:
Alignment of: R11723_PEA_1_P7 (SEQ ID NO:1411) x Q8N2G4 (SEQ ID NO:1709)..
Alignment segment 1/1:

| | | | |
|---|---|---|---|
| Quality: | 654.00 | Escore: | 0 |
| Matching length: | 64 | Total length: | 64 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAG  64
    ||||||||||||||
51  QDMCQKEVMEQSAG  64
```

Sequence name: /tmp/VXjdFlzdBX/bexTxTh0Th:BAC85273
Sequence documentation:
Alignment of: R11723_PEA_1_P7 (SEQ ID NO:1411) x BAC85273 ..
Alignment segment 1/1:

| | | | |
|---|---|---|---|
| Quality: | 600.00 | Escore: | 0 |
| Matching length: | 59 | Total length: | 59 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 6  IAATFCGLFLLPGFALQIQCYQCEEFQLNNDCSSPEFIVNCTVNVQDMCQ  55
    |||||||||||||||||||||||||||||||||||||||||||||||||
22  IAATFCGLFLLPGFALQIQCYQCEEFQLNNDCSSPEFIVNCTVNVQDMCQ  71

56  KEVMEQSAG  64
    |||||||||
72  KEVMEQSAG  80
```

Sequence name: /tmp/VXjdFlzdBX/bexTxTh0Th: BAC85518 (SEQ ID NO:1710)
Sequence documentation:
Alignment of: R11723_PEA__1_P7 (SEQ ID NO:1411) x BAC85518 (SEQ ID NO:1710) ..
Alignment segment 1/1:

| | | | |
|---|---|---|---|
| Quality: | 654.00 | Escore: | 0 |
| Matching length: | 64 | Total length: | 64 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
24  MWVLGIAATFCGLFLLPGFALQIQCYQCEEFQLNNDCSSPEFIVNCTVNV  73

51  QDMCQKEVMEQSAG  64
    ||||||||||||||
74  QDMCQKEVMEQSAG  87
```

Sequence name: /tmp/OLMSexEmIh/pc7Z7Xm1YR: Q96AC2 (SEQ ID NO:1708)
Sequence documentation:
Alignment of: R11723_PEA__1_P10 (SEQ ID NO:1413) x Q96AC2 (SEQ ID NO:1708) ..
Alignment segment 1/1:

| | | | |
|---|---|---|---|
| Quality: | 645.00 | Escore: | 0 |
| Matching length: | 63 | Total length: | 63 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSA  63
    |||||||||||||
51  QDMCQKEVMEQSA  63
```

Sequence name: /tmp/OLMSexEmIh/pc7Z7Xm1YR: Q8N2G4 (SEQ ID NO:1709)
Sequence documentation:
Alignment of: R11723_PEA_1_P10 (SEQ ID NO:1413) x Q8N2G4 (SEQ ID NO:1709) ..
Alignment segment 1/1:

| | | | |
|---|---|---|---|
| Quality: | 645.00 | Escore: | 0 |
| Matching length: | 63 | Total length: | 63 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1   MWVLGIAATFCGLFLLPGFALQIQCYQCEEFQLNNDCSSPEFIVNCTVNV   50
     |||||||||||||||||||||||||||||||||||||||||||||||||| 
 1   MWVLGIAATFCGLFLLPGFALQIQCYQCEEFQLNNDCSSPEFIVNCTVNV   50

51   QDMCQKEVMEQSA   63
     |||||||||||||
51   QDMCQKEVMEQSA   63
```

Sequence name: /tmp/OLMSexEmIh/pc7Z7Xm1YR: BAC85273
Sequence documentation:
Alignment of: R11723_PEA_1_P10 (SEQ ID NO:1413) x BAC85273 ..
Alignment segment 1/1:

| | | | |
|---|---|---|---|
| Quality: | 591.00 | Escore: | 0 |
| Matching length: | 58 | Total length: | 58 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 6   IAATFCGLFLLPGFALQIQCYQCEEFQLNNDCSSPEFIVNCTVNVQDMCQ   55
     |||||||||||||||||||||||||||||||||||||||||||||||||
22   IAATFCGLFLLPGFALQIQCYQCEEFQLNNDCSSPEFIVNCTVNVQDMCQ   71

56   KEVMEQSA   63
     ||||||||
72   KEVMEQSA   79
```

Sequence name: /tmp/OLMSexEmIh/pc7Z7Xm1YR: BAC85518 (SEQ ID NO:1710)
Sequence documentation:
Alignment of: R11723_PEA__1_P10 (SEQ ID NO:1413) x BAC85518 (SEQ ID NO:1710) ..
Alignment segment 1/1:

| Quality: | 645.00 | Escore: | 0 |
|---|---|---|---|
| Matching length: | 63 | Total length: | 63 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
24  MWVLGIAATFCGLFLLPGFALQIQCYQCEEFQLNNDCSSPEFIVNCTVNV  73

51  QDMCQKEVMEQSA  63
    |||||||||||||
74  QDMCQKEVMEQSA  86
```

Alignment of: R11723_PEA__1_P13 (SEQ ID NO:1412) x Q96AC2 (SEQ ID NO:1708) ..
Alignment segment 1/1:

| Quality: | 645.00 | Escore: | 0 |
|---|---|---|---|
| Matching length: | 63 | Total length: | 63 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSA  63
    |||||||||||||
51  QDMCQKEVMEQSA  63
```

It should be noted that the nucleotide transcript sequence of known protein (PSEC, also referred to herein as the "wild type" or WT protein) feature at least one SNP that appears to affect the coding region, in addition to certain silent SNPs. This SNP does not have an effect on the R11723_PEA_1_T5 (SEQ ID NO:148) splice variant sequence): "G->" resulting in a missing nucleotide (affects amino acids from position 91 onwards). The missing nucleotide creates a frame shift, resulting in a new protein. This SNP was not previously identified and is supported by 5 ESTs out of ~70 ESTs in this exon.

It should be noted that the variants of this cluster are variants of the hypothetical protein PSEC0181 (referred to herein as "PSEC"). Furthermore, use of the known protein (WT protein) for detection of lung cancer, alone or in combination with one or more variants of this cluster and/or of any other cluster and/or of any known marker, also comprises an embodiment of the present invention.

Expression of R11723 Transcripts which are Detectable by Amplicon as Depicted in Sequence Name R11723 seg13 (SEQ ID NO:1684) in Normal and Cancerous Lung Tissues Expression of transcripts detectable by or according to R11723 seg13, R11723 seg13 amplicon (SEQ ID NO:1684), and R11723 seg13F (SEQ ID NO:1682), and R11723 seg13R (SEQ ID NO:1683), primers was measured by real time PCR.

In parallel the expression of four housekeeping genes PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), and SDHA (GenBank Accession No. NM_004168 (SEQ ID NO:1712); amplicon—SDHA-amplicon, SEQ ID NO:331), Ubiquitin (GenBank Accession No. BC000449 (SEQ ID NO:1711); amplicon—Ubiquitin-amplicon, SEQ ID NO:328) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2

"Tissue samples in testing panel", above), to obtain a value of fold up-regulation for each sample relative to median of the normal PM samples.

Figure 48:
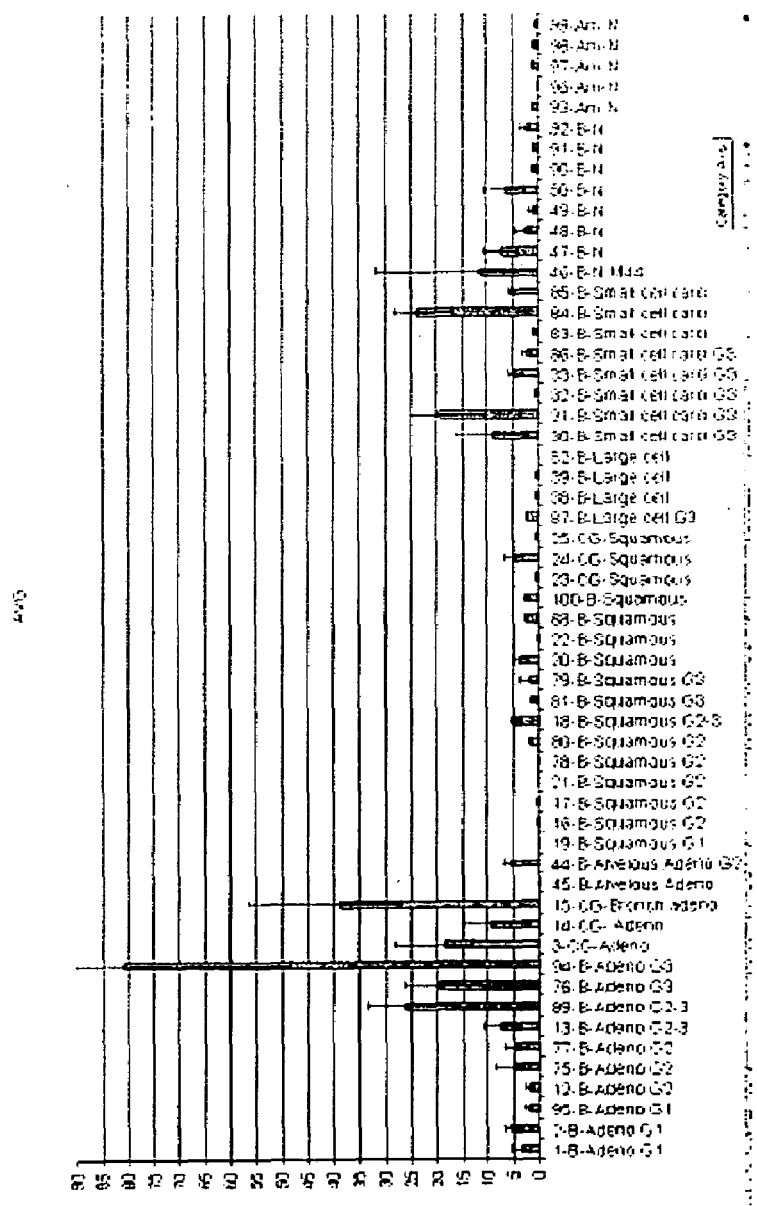
FIG. 48 is a histogram showing over expression of the R11723 transcripts, which are detectable by amplicon as depicted in sequence name R11723 seg13 (SEQ ID NO: 1684), in cancerous lung samples relative to the normal samples.

FIG. 48 is a histogram showing over expression of the above-indicated transcripts in cancerous lung samples relative to the normal samples. The number and percentage of samples that exhibit at least 5 fold over-expression, out of the total number of samples tested is indicated in the bottom.

As is evident from FIG. 48, the expression of transcripts detectable by the above amplicon(s) in cancer samples was higher than in the non-cancerous samples (Sample Nos. 47-50, 90-93, 96-99 Table 2 "Tissue samples in testing panel"). Notably an over-expression of at least 5 fold was found in 10 out of 15 adenocarcinoma samples, and in 4 out of 8 small cells carcinoma samples.

Primer pairs are also optionally and preferably encompassed within the present invention; for example, for the above experiment, the following primer pair was used as a non-limiting illustrative example only of a suitable primer pair: R11723 seg13F forward primer (SEQ ID NO: 1682); and R11723 seg13R reverse primer (SEQ ID NO: 1683).

The present invention also preferably encompasses any amplicon obtained through the use of any suitable primer pair; for example, for the above experiment, the following amplicon was obtained as a non-limiting illustrative example only of a suitable amplicon: R11723 seg13 (SEQ ID NO: 1684).

BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2 "Tissue samples in normal panel" above), to obtain a value of relative expression of each sample relative to median of the ovary samples.

```
R11723seg13F,-              (SEQ ID NO: 1682)
ACACTAAAAGAACAAACACCTTGCTC

R11723seg13R,-              (SEQ ID NO: 1683)
TCCTCAGAAGGCACATGAAAGA

R11723seg13 - amplicon,:  (SEQ ID NO: 1684)
ACACTAAAAGAACAAACACCTTGCTCTTCGAGATGAGACATTTTGCCAAGCAGTTG

ACCACTTAGTTCTCAAGAAGCAACTATCTCTTTCATGTGCCTTCTGAGGA
```

Figure 49:
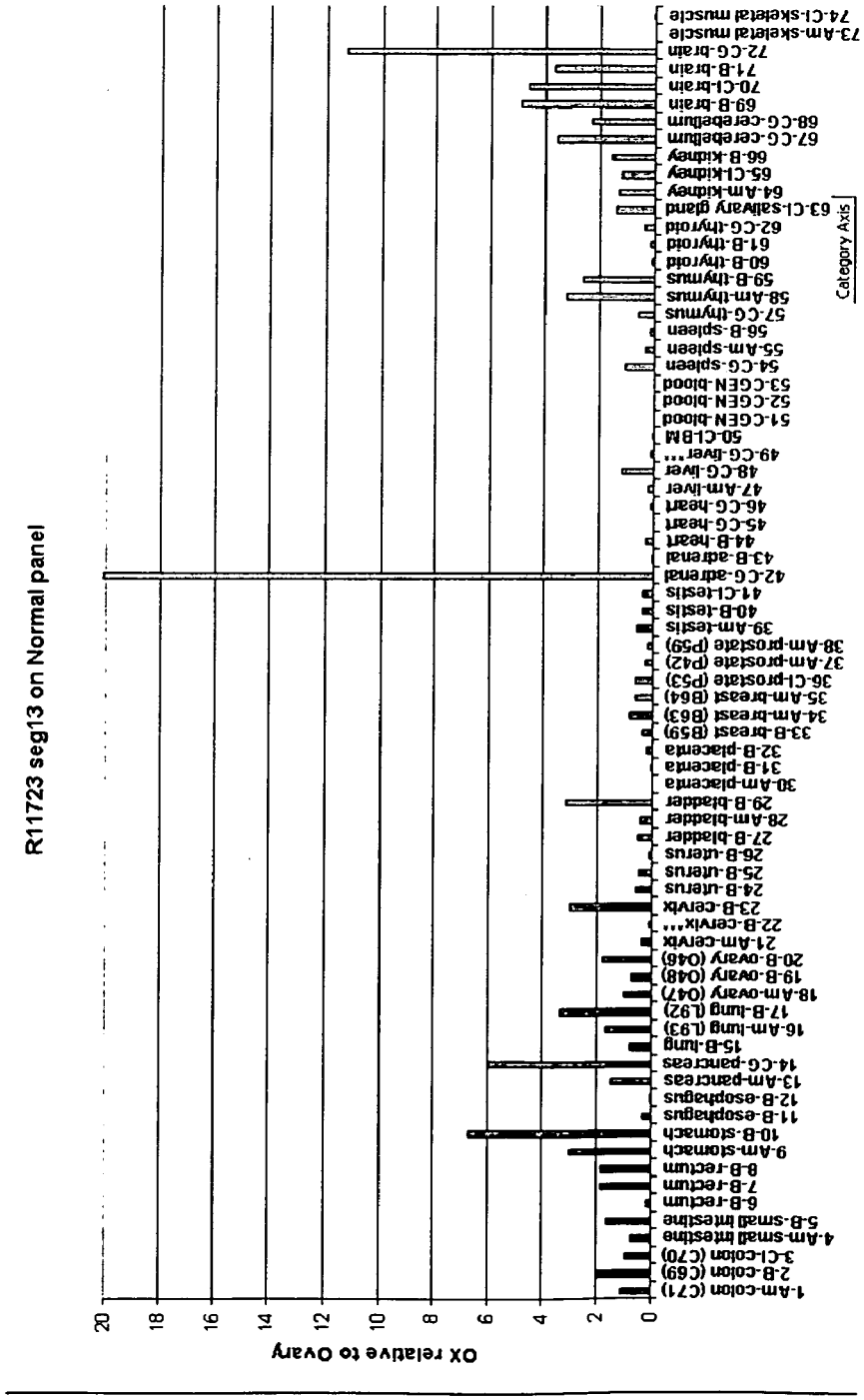
FIG. 49 is a histogram showing the expression of R11723 transcripts which are detectable by amplicon as depicted in sequence name R11723seg13 (SEQ ID NO:1684) in different normal tissues.

The results are presented in FIG. 49, showing the expression of R11723 transcripts which are detectable by amplicon as depicted in sequence name R11723seg13 (SEQ ID NO: 1684) in different normal tissues.

Expression of R11723 Transcripts, which are Detectable by Amplicon as Depicted in Sequence Name R1723 Junc11-18 (SEQ ID NO: 1687) in Normal and Cancerous Lung Tissues Expression of transcripts detectable by or according to junc11-18, R11723 junc11-18 amplicon (SEQ ID NO:1687) and R11723 junc11-18F (SEQ ID NO:1685) and R11723 junc11-18R (SEQ ID NO:1686) primers was measured by real time PCR (this junction is found in the known protein

```
R11723seg13F,-         (SEQ ID NO: 1682)
ACACTAAAAGAACAAACACCTTGCTC

R11723seg13R,-         (SEQ ID NO: 1683)
TCCTCAGAAGGCACATGAAAGA

R11723seg13 - amplicon,: (SEQ ID NO: 1684)
    ACACTAAAAGAACAAACACCTTGCTCTTCGAGATGAGACATTTTGCCAAGCA

GTTGACCACTTAGTTCTCAAGAAGCAACTATCTCTTTCATGTGCCTTCTGAGGA
```

Expression of R11723 Transcripts which are Detectable by Amplicon as Depicted in Sequence Name R11723seg13 (SEQ ID NO:1684) in Different Normal Tissues Expression of R11723 transcripts detectable by or according to R11723 seg13 amplicon (SEQ ID NO: 1684), and R11723seg13F (SEQ ID NO: 1682), R11723seg13R (SEQ ID NO: 1683), was measured by real time PCR. In parallel the expression of four housekeeping genes RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No. BC000449 (SEQ ID NO:1711); amplicon—Ubiquitin-amplicon, SEQ ID NO:328) was measured similarly. For each RT sample, the expression of the above amplicon was normalized to the geometric mean of the quantities of the housekeeping genes. The normalized quantity of each RT sample was then divided by the median of the quantities of the normal post-mortem sequence or "wild type" (WT) sequence, also termed herein the PSEC sequence). In parallel the expression of four housekeeping genes PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), SDHA (GenBank Accession No. NM_004168 (SEQ ID NO:1712); amplicon—SDHA-amplicon, SEQ ID NO:331), and Ubiquitin (GenBank Accession No. BC000449 (SEQ ID NO:1711); amplicon—Ubiquitin-amplicon, SEQ ID NO:328) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above: "Tissue samples in lung cancer testing panel"), to obtain a value of fold up-regulation for each sample relative to median of the normal PM samples.

Figure 50:
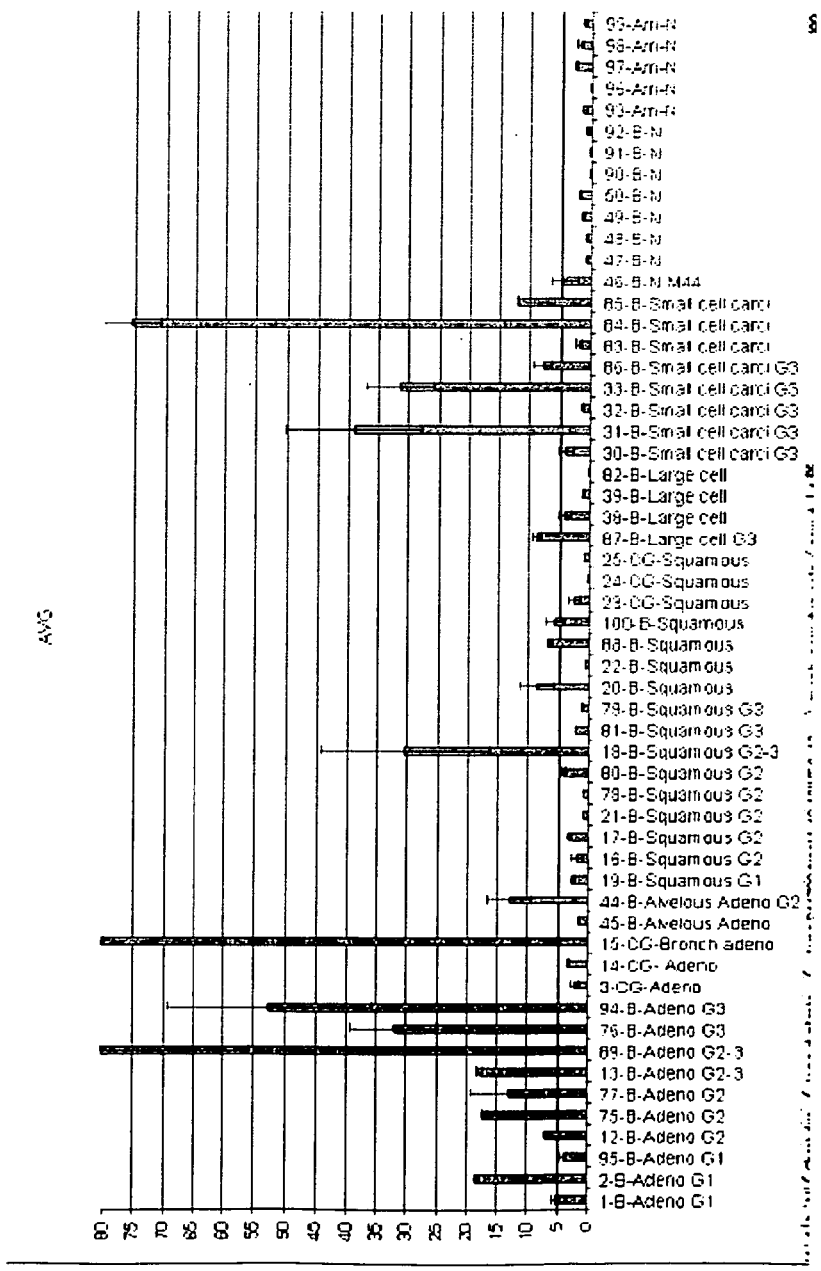
FIG. 50 is a histogram showing over expression of the R11723 transcripts, which are detectable by amplicon as depicted in sequence name R11723 junc11-18 (SEQ ID NO: 1687) in cancerous lung samples relative to the normal samples.

FIG. 50 is a histogram showing over expression of the above-indicated transcripts in cancerous lung samples relative to the normal samples. Values represent the average of duplicate experiments. Error bars indicate the minimal and maximal values obtained.

As is evident from FIG. 50, the expression of transcripts detectable by the above amplicon in cancer samples was higher than in the non-cancerous samples (Sample Nos. 47-50, 90-93, 96-99 Table 2 "Tissue samples in lung cancer testing panel"). Notably an over-expression of at least 5 fold was found in 11 out of 15 adenocarcinoma samples, 4 out of 16 squamous cell carcinoma samples, 1 out of 4 large cell carcinoma samples and in 5 out of 8 small cells carcinoma samples.

Primer pairs are also optionally and preferably encompassed within the present invention; for example, for the above experiment, the following primer pair was used as a non-limiting illustrative example only of a suitable primer pair: R11723 junc11-18F forward primer (SEQ ID NO: 1685); and R11723 junc11-18R reverse primer (SEQ ID NO: 1686).

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO: 1687).

```
R11723junc11-18F-          (SEQ ID NO: 1685)
AGTGATGGAGCAAAGTGCCG

R11723junc11-18R-          (SEQ ID NO: 1686)
CAGCAGCTGATGCAAACTGAG

R11723 junc11-18 - amplicon  (SEQ ID NO: 1687)
AGTGATGGAGCAAAGTGCCGGGATCATG-
TACCGCAAGTCCTGTGCATCATCAGCGG

CCTGTCTCATCGCCTCTGCCGGGTAC-
CAGTCCTTCTGCTCCCCAGGGAAACTGAACT

CAGTTTGCATCAGCTGCTG
```

Figure 73:
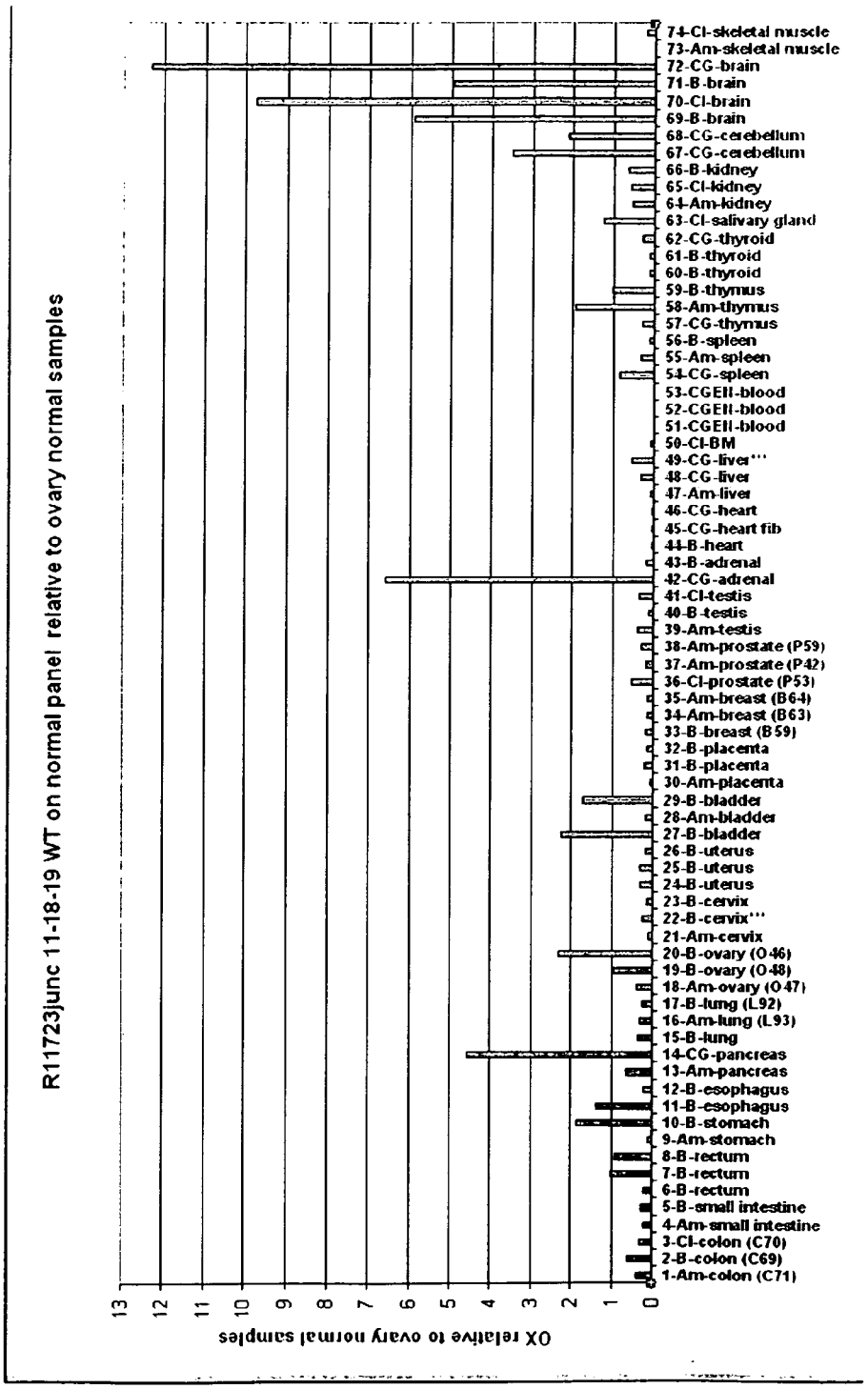
FIG. 73 is a histogram showing the expression of R11723 transcripts, which were detected by amplicon as depicted in the sequence name R11723 junc11-18 (SEQ ID NO:1687) in different normal tissues.

The results are demonstrated in FIG. 73, showing the expression of R11723 transcripts, which were detected by amplicon as depicted in the sequence name R11723 junc11-18 (SEQ ID NO: 1687) in different normal tissues.

Cloning of this Variant

Full Length Validation

RNA Preparation

Human adult papillary adenocarcinoma ovary RNA pool (lot# ILS1408) was obtained from ABS (http://www.abs-bioreagents, Wilmington, Del. 19801, USA com). Total RNA samples were treated with DNaseI (Ambion Cat # 1906).

```
R11723junc11-18F-          (SEQ ID NO: 1685)
AGTGATGGAGCAAAGTGCCG

R11723junc11-18R-          (SEQ ID NO: 1686)
CAGCAGCTGATGCAAACTGAG

R11723 junc11-18 - amplicon (SEQ ID NO: 1687)
AGTGATGGAGCAAAGTGCCGGGATCATGTACCGCAAGTCCTGTGCATCATCAGCGG

CCTGTCTCATCGCCTCTGCCGGGTACCAGTCCTTCTGCTCCCCAGGGAAACTGAACT

CAGTTTGCATCAGCTGCTG
```

Expression of R11723 Transcripts, which were Detected by Amplicon as Depicted in the Sequence Name R11723 Junc11-18 (SEQ ID NO:1687) in Different Normal Tissues Expression of R11723 transcripts detectable by or according to R11723seg13 amplicon (SEQ ID NO:1687) and R11723 junc11-18F (SEQ ID NO: 1685), R11723 junc11-18R(SEQ ID NO: 1686) was measured by real time PCR. In parallel the expression of four housekeeping genes RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20 Table 3 above), to obtain a value of relative expression of each sample relative to median of the ovary samples.

RT PCR

RT Preparation

Purified RNA (1 ug) was mixed with 150 ng Random Hexamer primers (Invitrogen Cat # 48190-011) and 500 uM dNTP (Takara, Cat # B9501-1) in a total volume of 15.6 ul DEPC—H$_2$O (Beit Haemek, Cat # 01-852-1A). The mixture was incubated for 5 min at 65° C. and then quickly chilled on ice. Thereafter, 5 ul of 5× Superscript II first strand buffer (Invitrogen, Cat #Y00146), 2.4 ul 0.1M DTT (Invitrogen, Cat #Y00147) and 40 units RNasin (Promega, Cat # N251A) were added, and the mixture was incubated for 2 min at 42° C. Then, 1 ul (200 units) of SuperscriptII (Invitrogen, Cat #18064-022) was added and the reaction was incubated for 50 min at 42° C. and then inactivated at 70° C. for 15 min. The resulting cDNA was diluted 1:20 in TE buffer (10 mM Tris pH=8, 1 mM EDTA pH=8).

PCR Amplification and Analysis cDNA (5 ul), prepared as described above, was used as a template in PCR reactions. The amplification was done using AccuPower PCR PreMix (Bioneer, Korea, Cat# K2016), under the following conditions: 1 ul—of each primer (10 uM) PSECfor—TGCTGTCGCCTCCTCTGATG (SEQ ID NO:1777) PSECrev—CCTCAGAAGGCACATGAAAG (SEQ ID NO:1778) plus 13 ul—H$_2$O were added into Accu-Power PCR PreMix tube with a reaction program of 5 minutes at 94° C.; 35 cycles of: [30 seconds at 94° C., 30 seconds at 52° C., 40 seconds at 72° C.] and 10 minutes at 72° C. At the end of the PCR amplification, products were analyzed on agarose gels stained with ethidium bromide and visualized with UV light. PCR product was extracted from the gel using QiaQuick™ gel extraction kit (Qiagen™, Cat #28706). The extracted DNA product (FIG. 79) was sequenced by direct sequencing using the gene specific primers from above (Hy-Labs, Israel), resulting in the expected sequence of PSEC variant R11723_PEA_1_T5 (SEQ ID NO:148) (FIG. 80).

Figure 79:
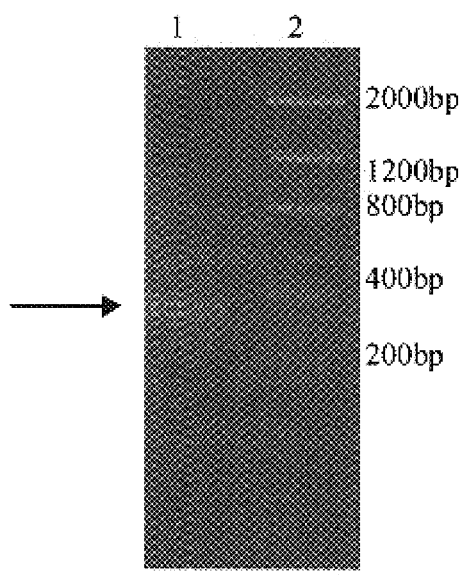
FIG. 79 shows PSEC R11723_PEA_1_T5 (SEQ ID NO:148) PCR product; Lane 1: PCR product; and Lane 2: Low DNA Mass Ladder MW marker (Invitrogen Cat# 10068-013).

It was concluded that the predicted PSEC variant R11723_PEA_1_T5 (SEQ ID NO:148) is indeed a naturally expressed variant in an adult papillary adenocarcinoma ovary human tissue as shown in FIG. 79.

Cloning of PSEC Variant R11723_PEA_1_T5 (SEQ ID NO:148) into Bacterial Expression Vector The PSEC splice variant R11723_PEA_1_T5 (SEQ ID NO:148) coding sequence was prepared for cloning by PCR amplification using the fragment described above as template and Platinum Pfx DNA polymerase (Invitrogen Cat # 11708021) under the following conditions: 5 ul—Amplification X10 buffer (Invitrogen Cat # 11708021); 2 ul—PCR product from above; 1 ul—dNTPs (10 mM each); 1 μl MgSO4 (50 mM) 5 ul enhancer solution (Invitrogen Cat # 11708021); 33 ul—H$_2$O; 1 ul—of each primer (10 uM) and 1.25 units of Taq polymerase [Platinum Pfx DNA polymerase (Invitrogen Cat # 11708021)] in a total reaction volume of 50 ul with a reaction program of 3 minutes at 94° C.; 29 cycles of: [30 seconds at 94° C., 30 seconds at 58° C., 40 seconds at 68° C.] and 7 minutes at 68° C. The Primers listed below include specific sequences of the nucleotide sequence corresponding to the splice variant and NheI and HindIII restriction sites.

PSEC Nhelfor—ATAGCTAGCATGTGGGTCCTAG-GCATCGCGG (SEQ ID NO:1779)

PSEC HindIIIrev—CCCAAGCTTCTAAGTGGTCAACT-GCTTGGC (SEQ ID NO:1780)

Figure 81:
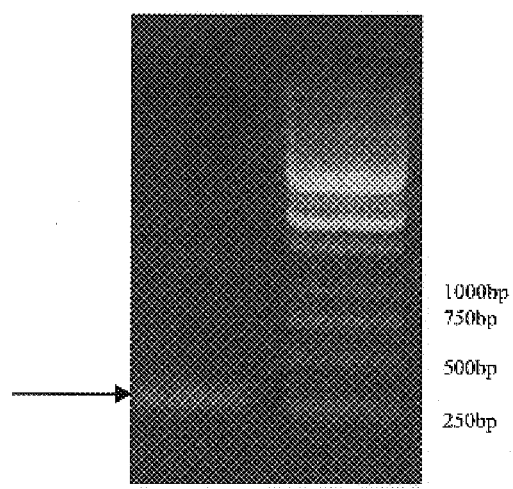
FIG. 81—PRSEC PCR product digested with NheI and HindIII; Lane 1—PRSET PCR product; Lane 2—Fermentas GeneRuler 1 Kb DNA Ladder #SM0313.
Figure 82:
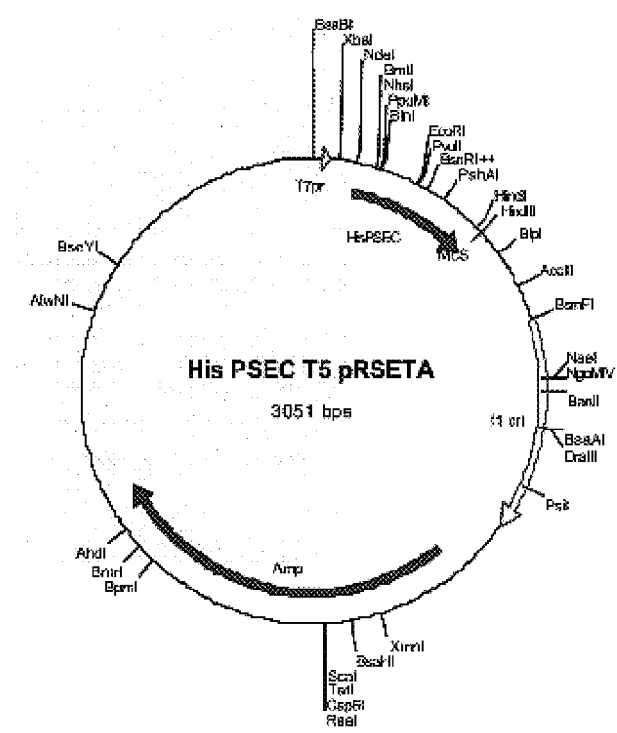
FIG. 82 shows a plasmid map of His PSEC T5 pRSETA.

The PCR product was then double digested with NheI and HindIII (New England Biolabs (UK) LTD) (FIG. 81), and inserted into pRSET-A (Invitrogen, Cat# V351-20), previously digested with the same enzymes, in-frame to an N-terminal 6His-tag, to give HisPSEC T5 pRSET (FIG. 82). The coding sequence encodes for a protein having the 6His-tag at the N' end (6His residues in a row at one end of the protein), and 8 additional amino acids encoded by the pRSET vector.

The sequence of the PSEC insert in the final plasmid, as well as its flanking regions, were verified by sequencing and found to be identical to the desired sequences. The complete sequence of His PSEC T5 pRESTA, including the sequenced regions, is shown in FIG. 84.

FIG. 83 shows the translated sequence of PSEC variant R11723_PEA_1_T5 (SEQ ID NO:148).

Bacterial Culture and Induction of Protein Expression

HisPSEC pRSETA DNA was transformed into competent DH5a cells (Invitrogen Cat#18258-012). Ampicillin resistant transformants were screened and positive clones were further analyzed by restriction enzyme digestion and sequence verification.

In order to express the recombinant protein, H is PSEC pRSETA DNA was further transformed into competent BL21 Gold cells (Stratagene Cat#230134) and BL21star (Invitrogen Cat# 44-0054). Ampicillin resistant transformants were screened and positive clones were selected.

Bacterial cells containing the H is PSEC T5 pRSET vector or empty pRSET vector (as negative control) were grown in LB medium, supplemented with Ampicillin (50 ug/ml) and chloramphenicol (34 ug/ml), until O.D. 600 nm reached 0.55. This value was reached in about 3 hours. 1 mM IPTG (Roche, Cat #724815) was added and the cells were grown at 37° C. overnight. 1 ml aliquots of each culture were removed for gel analysis at time zero, 3 hrs after induction and following overnight incubation (T0, T3 and T0/N, respectively).

Expression Results

Figure 85:
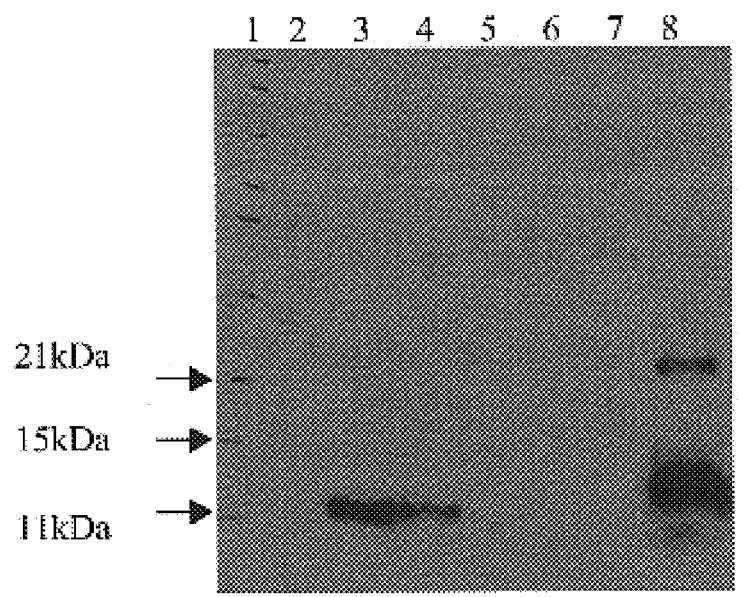
FIG. 85 shows Western blot analysis of recombinant H is PSEC variant R11723_PEA_1 T5; lane 1: molecular weight marker (ProSieve color, Cambrex, Cat #50550); lane 2: H is PSEC T5 pRSETA T0; lane 3: His H is PSEC T5 pRSETA T3; lane 4: His H is PSEC T5 pRSETA To.n; lane 5: pRSET empty vector T0 (negative control); lane 6: pRSET empty vector T3 (negative control); lane 7: pRSET empty vector To.n (negative control); and lane 8: His positive control protein (HisTroponinT7 pRSETA T3).

The time course of small-scale expression of PSEC in BL21 Gold is demonstrated in FIG. 85. The expression of a recombinant protein with the appropriate molecular weight (9.2 kDa) was visualized by Western Blot with anti-His antibodies (BD Clontech, Ref 631212, FIG. 85), but not by Coomassie staining (data not shown). Similar expression pattern was obtained with BL21 star as well (data not shown).

These results show that the protein encoded by PSEC variant R11723_PEA_1_T5 (SEQ ID NO:148) is indeed expressed in bacterial cells.

Description for Cluster R16276

Cluster R16276 features 1 transcript(s) and 5 segment(s) of interest, the names for which are given in Tables 1305 and 1306, respectively, the sequences themselves are given at the end of the application. The selected protein variants are given in table 1307.

TABLE 1305

Transcripts of interest

| Transcript Name | Sequence ID No. |
|---|---|
| R16276_PEA_1_T6 | 150 |

TABLE 1306

Segments of interest

| Segment Name | Sequence ID No. |
|---|---|
| R16276_PEA_1_node_0 | 1017 |
| R16276_PEA_1_node_6 | 1018 |
| R16276_PEA_1_node_1 | 1019 |
| R16276_PEA_1_node_4 | 1020 |
| R16276_PEA_1_node_5 | 1021 |

TABLE 1307

Proteins of interest

| Protein Name | Sequence ID No. | Corresponding Transcript(s) |
|---|---|---|
| R16276_PEA_1_P7 | 1414 | R16276_PEA_1_T6 (SEQ ID NO: 150) |

These sequences are variants of the known protein NOV protein homolog precursor (SwissProt accession identifier NOV_HUMAN; known also according to the synonyms NovH; Nephroblastoma overexpressed gene protein homolog), SEQ ID NO:1463, referred to herein as the previously known protein.

Protein NOV protein homolog precursor (SEQ ID NO:1463) is known or believed to have the following function(s): Immediate-early protein, likely to play a role in cell growth regulation (By similarity). The sequence for protein NOV protein homolog precursor is given at the end of the application, as "NOV protein homolog precursor amino acid sequence". Known polymorphisms for this sequence are as shown in Table 1308.

TABLE 1308

Amino acid mutations for Known Protein

| SNP position(s) on amino acid sequence | Comment |
|---|---|
| 97 | N -> K |

Protein NOV protein homolog precursor (SEQ ID NO:1463) localization is believed to be Secreted.

The following GO Annotation(s) apply to the previously known protein. The following annotation(s) were found: regulation of cell growth, which are annotation(s) related to Biological Process; insulin-like growth factor binding; growth factor, which are annotation(s) related to Molecular Function; and extracellular, which are annotation(s) related to Cellular Component.

The GO assignment relies on information from one or more of the SwissProt/TremB1 Protein knowledgebase, available from <dot expasy dot ch/sprot/>; or Locuslink, available from <dot ncbi dot nlm dot nih dot gov/projects/LocusLink/>.

Cluster R16276 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 51 refer to weighted expression of ESTs in each category, as "parts per million" (ratio of the expression of ESTs for a particular cluster to the expression of all ESTs in that category, according to parts per million).

Figure 51:
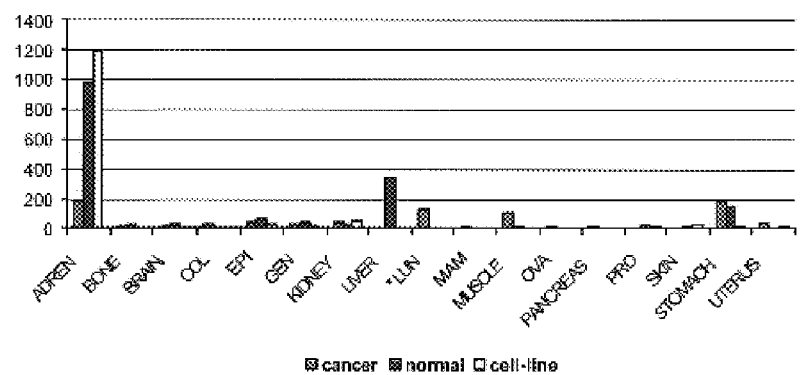
FIG. 51 is a histogram showing Cancer and cell-line vs. normal tissue expression for Cluster R16276, demonstrating overexpression in: lung malignant tumors.

Overall, the following results were obtained as shown with regard to the histograms in FIG. 51 and Table 1309. This cluster is overexpressed (at least at a minimum level) in the following pathological conditions: lung malignant tumors.

TABLE 1310

Normal tissue distribution

| Name of Tissue | Number |
|---|---|
| Adrenal | 977 |
| Bone | 32 |
| Brain | 24 |
| Colon | 0 |
| Epithelial | 63 |
| General | 43 |
| Kidney | 24 |
| Liver | 341 |
| Lung | 0 |
| Breast | 0 |
| Muscle | 20 |
| Ovary | 0 |
| Pancreas | 0 |
| Prostate | 24 |
| Skin | 13 |
| Stomach | 146 |
| Uterus | 0 |

TABLE 1311

P values and ratios for expression in cancerous tissue

| Name of Tissue | P1 | P2 | SP1 | R3 | SP2 | R4 |
|---|---|---|---|---|---|---|
| Adrenal | 5.9e−01 | 6.2e−01 | 1 | 0.2 | 9.9e−01 | 0.2 |
| Bone | 5.5e−01 | 7.3e−01 | 1 | 0.8 | 1 | 0.6 |
| Brain | 2.8e−01 | 4.4e−01 | 6.8e−01 | 0.9 | 8.9e−01 | 0.6 |
| Colon | 2.6e−01 | 3.3e−01 | 4.9e−01 | 2.0 | 5.9e−01 | 1.7 |
| Epithelial | 2.6e−01 | 2.9e−01 | 9.7e−01 | 0.6 | 1 | 0.5 |
| General | 4.1e−01 | 6.8e−01 | 9.4e−01 | 0.7 | 1 | 0.5 |
| Kidney | 8.3e−01 | 7.7e−01 | 6.2e−01 | 1.2 | 5.3e−01 | 1.4 |
| Liver | 9.1e−01 | 7.5e−01 | 1 | 0.1 | 1 | 0.1 |
| Lung | 2.3e−02 | 9.1e−02 | 8.0e−04 | 10.5 | 2.1e−02 | 5.1 |
| Breast | 5.9e−01 | 6.7e−01 | 6.9e−01 | 1.5 | 8.2e−01 | 1.2 |
| Muscle | 5.2e−01 | 6.1e−01 | 2.7e−01 | 3.2 | 6.3e−01 | 1.2 |
| Ovary | 6.2e−01 | 6.5e−01 | 6.8e−01 | 1.5 | 7.7e−01 | 1.3 |
| Pancreas | 3.3e−01 | 4.4e−01 | 4.2e−01 | 2.4 | 5.3e−01 | 1.9 |
| Prostate | 9.3e−01 | 9.4e−01 | 1 | 0.5 | 9.4e−01 | 0.6 |
| Skin | 9.2e−01 | 6.8e−01 | 1 | 0.5 | 4.1e−01 | 1.1 |
| Stomach | 5.0e−01 | 7.3e−01 | 5.0e−01 | 0.6 | 9.7e−01 | 0.4 |
| Uterus | 2.4e−01 | 1.6e−01 | 2.9e−01 | 2.5 | 4.1e−01 | 2.0 |

As noted above, cluster R16276 features 1 transcript(s), which were listed in Table 1 above. These transcript(s) encode for protein(s) which are variant(s) of protein NOV protein homolog precursor (SEQ ID NO:1463). A description of each variant protein according to the present invention is now provided.

Variant protein R16276_PEA__1_P7 (SEQ ID NO:1414) according to the present invention has an amino acid sequence as given at the end of the application; it is encoded by transcript(s) R16276_PEA__1_T6 (SEQ ID NO:150). An alignment is given to the known protein (NOV protein homolog precursor (SEQ ID NO:1463)) at the end of the application. One or more alignments to one or more previously published protein sequences are given at the end of the application. A brief description of the relationship of the variant protein according to the present invention to each such aligned protein is as follows:

Comparison Report Between R16276_PEA__1_P7 (SEQ ID NO:1414) and NOV_HUMAN (SEQ ID NO:1463):

1. An isolated chimeric polypeptide encoding for R16276_PEA__1_P7 (SEQ ID NO:1414), comprising a first amino acid sequence being at least 90% homologous to MQSVQSTSFCLRKQCLCLT-FLLLHLLGQVAATQRCPPQCPG corresponding to amino acids 1-41 of NOV_HUMAN (SEQ ID NO:1463), which also corresponds to amino acids 1-41 of R16276_PEA__1_P7 (SEQ ID NO:1414), a bridging amino acid Q corresponding to amino acid 42 of R16276_PEA__1_P7 (SEQ ID NO:1414), a second amino acid sequence being at least 90% homologous to CPATPPTCAPGVRAVLDGCSCCLVCAR-QRGESCSDLEPCDESSGLYCDRSADPSNQTGI CT corresponding to amino acids 43-103 of NOV_HUMAN (SEQ ID NO:1463), which also corresponds to amino acids 43-103 of R16276_PEA__1_P7 (SEQ ID NO:1414), and a third amino acid sequence being at least 70%, optionally at least 80%, preferably at least 85%, more preferably at least 90% and most preferably at least 95% homologous to a polypeptide having the sequence GNPAPSAV (SEQ ID NO:1748) corresponding to amino acids 104-111 of R16276_PEA__1_P7 (SEQ ID NO:1414), wherein said first amino acid sequence, bridging amino acid, second amino acid sequence and third amino acid sequence are contiguous and in a sequential order.

2. An isolated polypeptide encoding for a tail of R16276_PEA__1_P7 (SEQ ID NO:1414), comprising a polypeptide being at least 70%, optionally at least about 80%, preferably at least about 85%, more preferably at least about 90% and most preferably at least about 95% homologous to the sequence GNPAPSAV (SEQ ID NO:1748) in R16276_PEA_1_P7 (SEQ ID NO:1414).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R16276_PEA_1_P7 (SEQ ID NO:1414) also has the following non-silent SNPs (Single Nucleotide Polymorphisms) as listed in Table 1312, (given according to their position(s) on the amino acid sequence, with the alternative amino acid(s) listed; the last column indicates whether the SNP is known or not; the presence of known SNPs in variant protein R16276_PEA_1_P7 (SEQ ID NO:1414) sequence provides support for the deduced sequence of this variant protein according to the present invention).

TABLE 1313

Amino acid mutations

| SNP position(s) on amino acid sequence | Alternative amino acid(s) | Previously known SNP? |
|---|---|---|
| 42 | Q -> R | Yes |

The glycosylation sites of variant protein R16276_PEA_1_P7 (SEQ ID NO:1414), as compared to the known protein NOV protein homolog precursor (SEQ ID NO:1463), are described in Table 1314 (given according to their position(s) on the amino acid sequence in the first column; the second column indicates whether the glycosylation site is present in the variant protein; and the last column indicates whether the position is different on the variant protein).

TABLE 1314

Glycosylation site(s)

| Position(s) on known amino acid sequence | Present in variant protein? | Position in variant protein? |
|---|---|---|
| 280 | no | |
| 97 | yes | 97 |

Variant protein R16276_PEA_1_P7 (SEQ ID NO:1414) is encoded by the following transcript(s): R16276_PEA_1_T6 (SEQ ID NO:150), for which the sequence(s) is/are given at the end of the application. The coding portion of transcript R16276_PEA_1_T6 (SEQ ID NO:150) is shown in bold; this coding portion starts at position 445 and ends at position 777. The transcript also has the following SNPs as listed in Table 1315 (given according to their position on the nucleotide sequence, with the alternative nucleic acid listed; the last column indicates whether the SNP is known or not; the presence of known SNPs in variant protein R16276_PEA_1_P7 (SEQ ID NO:1414) sequence provides support for the deduced sequence of this variant protein according to the present invention).

TABLE 1315

Nucleic acid SNPs

| SNP position on nucleotide sequence | Alternative nucleic acid | Previously known SNP? |
|---|---|---|
| 371 | G -> | No |
| 430 | A -> G | No |
| 569 | A -> G | Yes |
| 729 | C -> A | Yes |
| 827 | G -> T | Yes |

As noted above, cluster R16276 features 5 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R16276_PEA_1_node_0 (SEQ ID NO:1017) according to the present invention is supported by 35 libraries. The number of libraries was determined as previously described. This segment can be found in the following transcript(s): R16276_PEA_1_T6 (SEQ ID NO:150). Table 1316 below describes the starting and ending position of this segment on each transcript.

TABLE 1316

Segment location on transcripts

| Transcript name | Segment starting position | Segment ending position |
|---|---|---|
| R16276_PEA_1_T6 (SEQ ID NO: 150) | 1 | 438 |

Segment cluster R16276_PEA_1_node_6 (SEQ ID NO:1018) according to the present invention is supported by 2 libraries. The number of libraries was determined as previously described. This segment can be found in the following transcript(s): R16276_PEA_1_T6 (SEQ ID NO:150). Table 1317 below describes the starting and ending position of this segment on each transcript.

TABLE 1317

Segment location on transcripts

| Transcript name | Segment starting position | Segment ending position |
|---|---|---|
| R16276_PEA_1_T6 (SEQ ID NO: 150) | 755 | 876 |

According to an optional embodiment of the present invention, short segments related to the above cluster are also provided. These segments are up to about 120 bp in length, and so are included in a separate description.

Segment cluster R16276_PEA_1_node_1 (SEQ ID NO:1019) according to the present invention is supported by 37 libraries. The number of libraries was determined as previously described. This segment can be found in the following transcript(s): R16276_PEA_1_T6 (SEQ ID NO:150). Table 1318 below describes the starting and ending position of this segment on each transcript.

TABLE 1318

Segment location on transcripts

| Transcript name | Segment starting position | Segment ending position |
|---|---|---|
| R16276_PEA_1_T6 (SEQ ID NO: 150) | 439 | 528 |

Segment cluster R16276_PEA_1_node_4 (SEQ ID NO:1020) according to the present invention is supported by 38 libraries. The number of libraries was determined as previously described. This segment can be found in the following transcript(s): R16276_PEA_1_T6 (SEQ ID NO:150). Table 1319 below describes the starting and ending position of this segment on each transcript.

TABLE 1319

Segment location on transcripts

| Transcript name | Segment starting position | Segment ending position |
|---|---|---|
| R16276_PEA_1_T6 (SEQ ID NO: 150) | 529 | 639 |

Segment cluster R16276_PEA_1_node_5 (SEQ ID NO:1021) according to the present invention is supported by 37 libraries. The number of libraries was determined as previously described. This segment can be found in the following transcript(s): R16276_PEA_1_T6 (SEQ ID NO:150). Table 1320 below describes the starting and ending position of this segment on each transcript.

TABLE 1320

Segment location on transcripts

| Transcript name | Segment starting position | Segment ending position |
|---|---|---|
| R16276_PEA_1_T6 (SEQ ID NO: 150) | 640 | 754 |

Variant Protein Alignment to the Previously Known Protein:
Sequence name: NOV_HUMAN (SEQ ID NO:1463)
Sequence documentation:
Alignment of: R16276_PEA_1_P7 (SEQ ID NO:1414) x NOV_HUMAN (SEQ ID NO:1463)..
Alignment segment 1/1:

| | | | | |
|---|---|---|---|---|
| Quality: | 1042.00 | Escore: | | 0 |
| Matching length: | 103 | Total length: | | 103 |
| Matching Percent | 100.00 | Matching Percent Identity: | | 99.03 |
| Similarity: | | | | |
| Total Percent Similarity: | 100.00 | Total Percent Identity: | | 99.03 |
| Gaps: | 0 | | | |

Alignment:

```
  1 MQSVQSTSFCLRKQCLCLTFLLLHLLGQVAATQRCPPQCPGQCPATPPTC   50
    |||||||||||||||||||||||||||||||||||:||||||||||
  1 MQSVQSTSFCLRKQCLCLTFLLLGLLGQVAATQRCPPQCPGRCPATPPTC   50

51 APGVRAVLDGCSCCLVCARQRGESCSDLEPCDESSGLYCDRSADPSNQTG  100
    |||||||||||||||||||||||||||||||||||||||||||||||||
 51 APGVRAVLDGCSCCLVCARQRGESCSDLEPCDESSGLYCDRSADPSNQTG  100

101 ICT                                                103
    |||
101 ICT                                                103
```

Combined Expression of 6 Sequences H61775seg8 (SEQ ID NO: 1636), HUMGRP5E Junc3-7 (SEQ ID NO: 1648), M85491Seg24 (SEQ ID NO: 1639), Z21368 Junc17-21 (SEQ ID NO: 1642), HSSTROL3seg24 (SEQ ID NO: 1675) and Z25299seg20 (SEQ ID NO: 1669) in Normal and Cancerous Lung Tissues Expression of immunoglobulin superfamily, member 9, gastrin-releasing peptide, Ephrin type-B receptor 2 precursor, SUL1_HUMAN, Stromelysin-3 Precursor (EC 3.4.24.-) (Matrix metalloproteinase-11) (MMP-11) (ST3) (SL-3) and Secretory leukocyte protease inhibitor Acid-stable proteinase inhibitor transcripts detectable by or according to H61775seg8 (SEQ ID NO: 1636), HUMGRP5E junc3-7 (SEQ ID NO:1648), M85491Seg24 (SEQ ID NO: 1639), Z21368 junc17-21 (SEQ ID NO: 1642), HSSTROL3seg24 (SEQ ID NO:1675) and Z25299seg20 amplicons (SEQ ID NO:1669) and H61775seg8F2 (SEQ ID NO: 1634), H61775seg8R2 (SEQ ID NO: 1635), HUMGRP5E junc3-7F (SEQ ID NO:1646), HUMGRP5E junc3-7R (SEQ ID NO: 1647), M85491 Seg24F (SEQ ID NO: 1637), M85491Seg24R (SEQ ID NO: 1638), Z21368 junc17-21F (SEQ ID NO: 1640), Z21368 junc17-21R (SEQ ID NO: 1641), HSSTROL3seg24F (SEQ ID NO: 1673), HSSTROL3seg24R (SEQ ID NO: 1674), Z25299seg20F (SEQ ID NO: 1667), Z25299seg20R (SEQ ID NO: 1668) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (Gen- Bank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the 5 above amplicons was normalized to the geometric mean of the quantities of the housekeeping genes. The normalized quantity of each RT sample of each amplicon was then divided by the median of the quantities of the normal postmortem (PM) samples detected for the same amplicon (Sample Nos. 47-50, 90-93, 96-99, Table 2, "Tissue samples in testing panel", above), to obtain a value of fold up-regulation for each sample relative to median of the normal PM samples. The reciprocal of this ratio was calculated for Z25299seg20 (SEQ ID NO:1669), to obtain a value of fold down-regulation for each sample relative to median of the normal PM samples.

Figure 52:
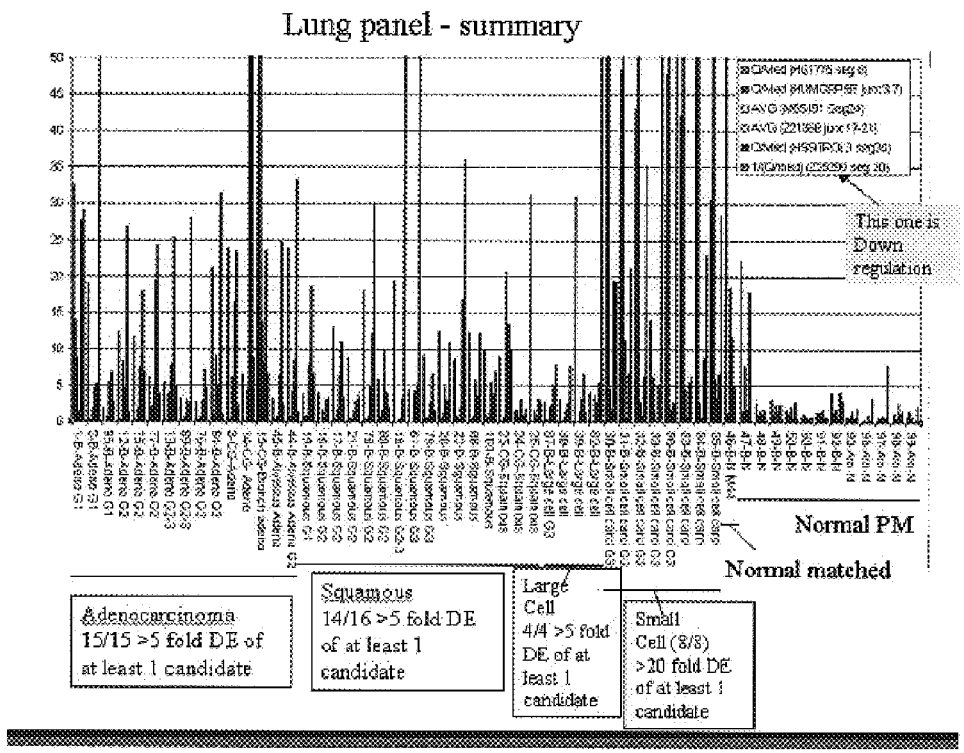
FIGS. 52-53 are histograms, showing differential expression of the 6 sequences H61775seg8 (SEQ ID NO:1636), HUMGRP5E junc3-7 (SEQ ID NO:1648), M85491Seg24 (SEQ ID NO:1639), Z21368 junc17-21 (SEQ ID NO:1642), HSSTROL3seg24 (SEQ ID NO: 1675) and Z25299seg20 (SEQ ID NO:1669) in in cancerous lung samples relative to the normal samples.
Figure 53:
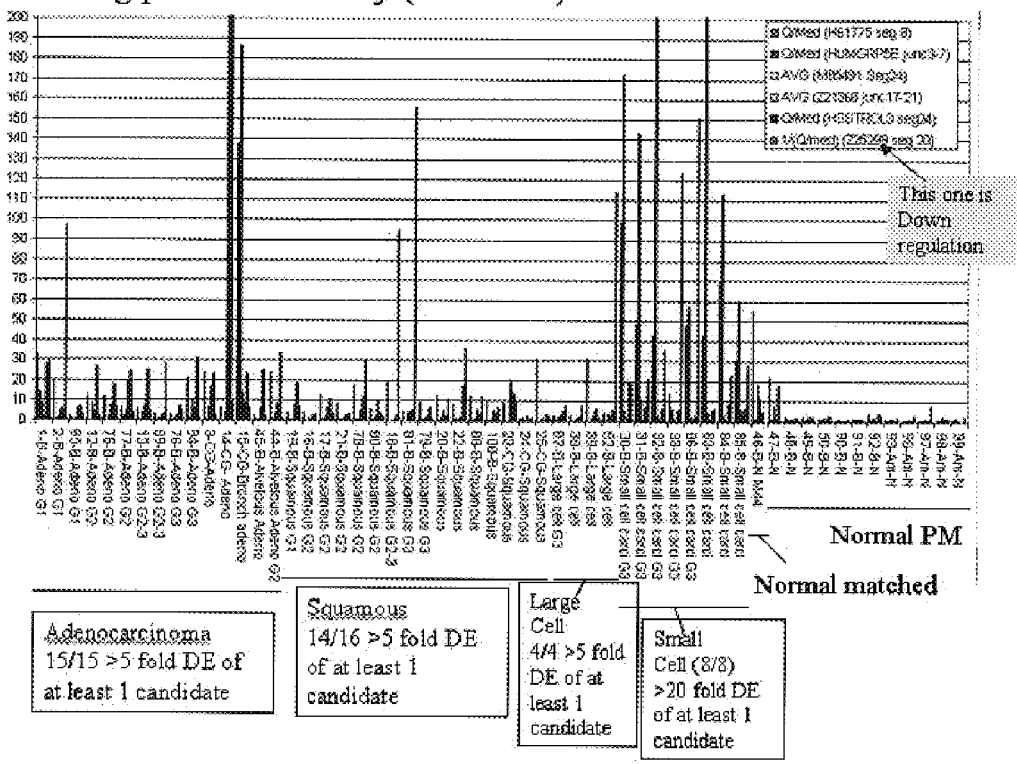

FIGS. 52-53 are histograms showing differential expression of the above-indicated transcripts in cancerous lung samples relative to the normal samples. The number and percentage of samples that exhibit at least 5 fold differential of at least one of the sequences, out of the total number of samples tested is indicated in the bottom.

As is evident from FIGS. 52-53, differential expression of at least 5 fold in at least one of the sequences was found in 15 out of 15 adenocarcinoma samples, 14 out of 16 squamous cell carcinoma samples, 4 out of 4 large cell carcinoma samples and in 8 out of 8 small cell carcinoma samples.

Statistical analysis was applied to verify the significance of these results, as described below. Threshold of 5 fold differential expression of at least one of the amplicons was found to differentiate between cancer and normal samples with P value of 7.82E-06 in adenocarcinoma, 2.63E-04 in squamous cell carcinoma, 8.24E-03 in large cell adenocarcinoma and 3.57E-04 in small cell carcinoma as checked by exact fisher test.

The above values demonstrate statistical significance of the results.

Description for Cluster H53626

Cluster H53626 features 2 transcript(s) and 20 segment(s) of interest, the names for which are given in Tables 1321 and 1322, respectively, the sequences themselves are given at the end of the application.

TABLE 1321

Transcripts of interest

| Transcript Name | SEQ ID NO: |
| --- | --- |
| H53626_PEA_1_T15 | 16 |
| H53626_PEA_1_T16 | 17 |

TABLE 1322

Segments of interest

| Segment Name | SEQ ID NO: |
| --- | --- |
| H53626_PEA_1_node_15 | 18 |
| H53626_PEA_1_node_22 | 19 |
| H53626_PEA_1_node_25 | 306 |
| H53626_PEA_1_node_26 | 307 |
| H53626_PEA_1_node_27 | 308 |
| H53626_PEA_1_node_34 | 309 |
| H53626_PEA_1_node_35 | 310 |

TABLE 1322-continued

Segments of interest

| Segment Name | SEQ ID NO: |
| --- | --- |
| H53626_PEA_1_node_36 | 311 |
| H53626_PEA_1_node_11 | 312 |
| H53626_PEA_1_node_12 | 313 |
| H53626_PEA_1_node_16 | 314 |
| H53626_PEA_1_node_19 | 315 |
| H53626_PEA_1_node_20 | 316 |
| H53626_PEA_1_node_24 | 317 |
| H53626_PEA_1_node_28 | 318 |
| H53626_PEA_1_node_29 | 319 |
| H53626_PEA_1_node_30 | 320 |
| H53626_PEA_1_node_31 | 321 |
| H53626_PEA_1_node_32 | 322 |
| H53626_PEA_1_node_33 | 323 |

TABLE 1323

Proteins of interest

| Transcript Name | SEQ ID NO: |
| --- | --- |
| H53626_PEA_1_P4 | 324 |
| H53626_PEA_1_P5 | 325 |

Cluster H53626 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 76 below refer to weighted expression of ESTs in each category, as "parts per million" (ratio of the expression of ESTs for a particular cluster to the expression of all ESTs in that category, according to parts per million).

Figure 76:
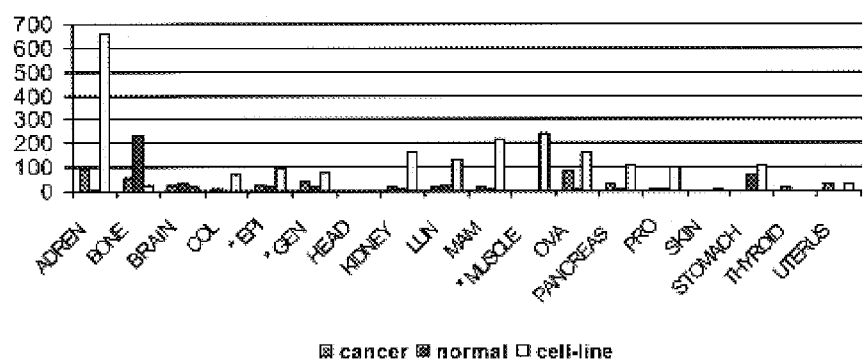
FIG. 76 is a histogram showing Cancer and cell-line vs. normal tissue expression for Cluster H53626, demonstrating overexpression in epithelial malignant tumors, a mixture of malignant tumors from different tissues and myosarcoma.

Overall, the following results were obtained as shown with regard to the histograms in FIG. 76 and Table 1324. This cluster is overexpressed (at least at a minimum level) in the following pathological conditions: epithelial malignant tumors, a mixture of malignant tumors from different tissues and myosarcoma.

TABLE 1324

Normal tissue distribution

| Name of Tissue | Number |
| --- | --- |
| adrenal | 4 |
| bone | 233 |
| brain | 33 |
| colon | 0 |
| epithelial | 12 |
| general | 17 |
| head and neck | 0 |
| kidney | 8 |
| lung | 25 |
| breast | 8 |
| muscle | 0 |
| ovary | 7 |
| pancreas | 10 |
| prostate | 8 |
| skin | 0 |
| stomach | 73 |
| Thyroid | 0 |
| uterus | 0 |

TABLE 1325

P values and ratios for expression in cancerous tissue

| Name of Tissue | P1 | P2 | SP1 | R3 | SP2 | R4 |
|---|---|---|---|---|---|---|
| adrenal | 6.4e−01 | 4.2e−01 | 2.1e−01 | 3.1 | 1.3e−02 | 4.1 |
| bone | 5.8e−01 | 8.1e−01 | 9.8e−01 | 0.3 | 1.0e+00 | 0.3 |
| brain | 2.2e−01 | 2.6e−01 | 8.1e−01 | 0.8 | 8.9e−01 | 0.6 |
| colon | 2.3e−01 | 1.4e−01 | 1.5e+00 | 1.2 | 4.6e−01 | 1.9 |
| epithelial | 8.3e−02 | 4.8e−03 | 6.4e−02 | 1.5 | 6.6e−08 | 4.1 |
| general | 2.4e−03 | 1.5e−05 | 1.1e−03 | 1.6 | 2.0e−12 | 3.1 |
| head and neck | 2.1e−01 | 3.3e−01 | 0.0e+00 | 0.0 | 0.0e+00 | 0.0 |
| kidney | 7.3e−01 | 5.8e−01 | 5.8e−01 | 1.3 | 5.7e−02 | 2.0 |
| lung | 8.3e−01 | 5.5e−01 | 7.9e−01 | 0.8 | 3.2e−02 | 2.1 |
| breast | 6.5e−01 | 2.7e−01 | 6.9e−01 | 1.2 | 7.8e−02 | 1.9 |
| muscle | 1.5e+00 | 2.9e−01 | 1.5e+00 | 1.0 | 3.5e−03 | 4.1 |
| ovary | 6.7e−01 | 5.6e−01 | 1.5e−01 | 1.7 | 7.0e−02 | 2.7 |
| pancreas | 2.3e−01 | 2.0e−01 | 3.9e−01 | 1.9 | 8.2e−02 | 2.3 |
| prostate | 9.0e−01 | 9.0e−01 | 6.7e−01 | 1.1 | 1.8e−01 | 1.9 |
| skin | 1.5e+00 | 4.4e−01 | 1.5e+00 | 1.0 | 6.4e−01 | 1.6 |
| stomach | 9.0e−01 | 3.4e−01 | 1.0e+00 | 0.3 | 6.1e−01 | 0.9 |
| Thyroid | 2.4e−01 | 2.4e−01 | 1.5e+00 | 1.1 | 1.5e+00 | 1.1 |
| uterus | 2.1e−01 | 2.4e−01 | 2.9e−01 | 2.5 | 2.6e−01 | 2.2 |

As noted above, contig H53626 features 2 transcript(s), which were listed in Table 1321 above. A description of each variant protein according to the present invention is now provided.

Variant protein H53626_PEA_1_P4 (SEQ ID NO:324) according to the present invention has an amino acid sequence as given at the end of the application; it is encoded by transcript(s) H53626_PEA_1_T15 (SEQ ID NO:16). The alignment to the wild type protein is given at the end of the application. A brief description of the relationship of the variant protein according to the present invention to the wild type protein is as follows:

Comparison Report Between H53626_PEA_1_P4 (SEQ ID NO:324) and Wild Type Q8N441 (SEQ ID NO:1699):

1. An isolated chimeric polypeptide encoding for H53626_PEA_1_P4 (SEQ ID NO:324), comprising a first amino acid sequence being at least 90% homologous to MTPSPLLLLLLPPLLLGAFPPAAAARGP-PKMADKVVPRQVARLGRTVRLQCPVEGDPPP LTM-WTKDGRTIHSGWSRFRV-LPQGLKVKQVEREDAGVYVCKATNGFGSLSVNYTLVV LDDISPGKESLGPDSSSGGQEDPAS-QQWARPRFTQPSKMRRRVIARPVGSSVRLKCVAS GHPRPDITWMKDDQALTR-PEAAEPRKKKWTLSLKNLRPEDSGKYT-CRVSNRAGAINAT YKVDVIQRTRSKPVLTGTHPVNT-TVDFGGTTSFQCKVRSDVKPVIQWLKRVEYGAEGR HNSTIDVGGQKFVVLPTGDVWSRPDG-SYLNKLLITRARQDDAGMYICLGANTMGYSFR SAFLTVLP corresponding to amino acids 1-357 of Q8N441 (SEQ ID NO:1699), which also corresponds to amino acids 1-357 of H53626_PEA_1_P4 (SEQ ID NO:324), second amino acid sequence being at least 70%, optionally at least 80%, preferably at least 85%, more preferably at least 90% and most preferably at least 95% homologous to a polypeptide having the sequence GARLPRHATPCWCPDPPPG-PGVPPTGWGPTLPSRAVLARSSAEG-GQPRGTVSTAPGMG LGCSPGLCVGVPLPTSFPLALA (SEQ ID NO:1775) corresponding to amino acids 358-437 of H53626_PEA_1_P4 (SEQ ID NO:324), and a third amino acid sequence being at least 90% homologous to DPKPPG-PPVASSSSATSLPWPVVIGIPAGAV-FILGTLLLWLCQAQKKPCTPAPAPPLPGH RPPG-TARDRSGDKDLPSLAALSAGPGVGLCEEHGSP APQHLLGPGPVAGPKLYPKLY TDIHTHTHTHSHTHS-HVEGKVHQHIHYQC corresponding to amino acids 358-504 of Q8N441 (SEQ ID NO:1699), which also corresponds to amino acids 438-584 of H53626_PEA_1_P4 (SEQ ID NO:324), wherein said first, second and third amino acid sequences are contiguous and in a sequential order.

2. An isolated polypeptide encoding for an edge portion of H53626_PEA_1_P4 (SEQ ID NO:324), comprising an amino acid sequence being at least 70%, optionally at least about 80%, preferably at least about 85%, more preferably at least about 90% and most preferably at least about 95% homologous to the sequence encoding for GARLPRHAT-PCWCPDPPPGPGVPPTGWGPTLPSRAV-LARSSAEGGQPRGTVSTAPGMG LGCSPGLCVGV-PLPTSFPLALA (SEQ ID NO:1775), corresponding to H53626_PEA_1_P4 (SEQ ID NO:324).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein H53626_PEA_1_P4 (SEQ ID NO:324) also has the following non-silent SNPs (Single Nucleotide Polymorphisms) as listed in Table 1326, (given according to their position(s) on the amino acid sequence, with the alternative amino acid(s) listed; the last column indicates whether the SNP is known or not; the presence of known SNPs in variant protein H53626_PEA_1_P4 (SEQ ID NO:324) sequence provides support for the deduced sequence of this variant protein according to the present invention).

TABLE 1326

Amino acid mutations

| SNP position(s) on amino acid sequence | Alternative amino acid(s) | Previously known SNP? |
|---|---|---|
| 193 | R -> L | Yes |
| 300 | G -> | No |
| 319 | Y -> H | No |
| 442 | P -> Q | Yes |
| 504 | R -> L | Yes |
| 521 | G -> | No |
| 544 | P -> L | Yes |
| 573 | E -> G | No |

Variant protein H53626_PEA_1_P4 (SEQ ID NO:324) is encoded by the following transcript(s): H53626_PEA_1_T15 (SEQ ID NO:16), for which the sequence(s) is/are given at of the application. The coding portion of transcript H53626_PEA_1_T15 (SEQ ID NO:16) is shown in bold; this coding portion starts at position 17 and ends at position 1771. The transcript also has the following SNPs as listed in Table 1327 (given according to their position on the nucleotide sequence, with the alternative nucleic acid listed; the last column indicates whether the SNP is known or not; the presence of known SNPs in variant protein H53626_PEA_1_P4 (SEQ ID NO:324) sequence provides support for the deduced sequence of this variant protein according to the present invention).

TABLE 1327

Nucleic acid SNPs

| SNP position on nucleotide sequence | Alternative nucleic acid | Previously known SNP? |
|---|---|---|
| 76 | G -> A | Yes |
| 340 | G -> T | No |
| 1647 | C -> T | Yes |
| 1734 | A -> G | No |
| 1797 | G -> | No |
| 1948 | A -> G | Yes |
| 2193 | C -> T | Yes |
| 2308 | C -> T | Yes |
| 2333 | C -> G | Yes |
| 2648 | C -> T | Yes |
| 2649 | G -> A | Yes |
| 2765 | C -> T | Yes |
| 594 | G -> T | Yes |
| 2972 | G -> A | Yes |
| 3027 | C -> G | Yes |
| 907 | T -> C | Yes |
| 916 | C -> | No |
| 971 | T -> C | No |
| 1135 | G -> A | Yes |
| 1341 | C -> A | Yes |
| 1527 | G -> T | Yes |
| 1579 | C -> | No |

Variant protein H53626_PEA_1_P5 (SEQ ID NO:325) according to the present invention has an amino acid sequence as given at the end of the application; it is encoded by transcript(s) H53626_PEA_1_T16 (SEQ ID NO:17). The alignment to the wild type protein is given at the end of the application. A brief description of the relationship of the variant protein according to the present invention to the wild type protein is as follows:

Comparison Report Between H53626_PEA_1_P5 (SEQ ID NO:325) and Wild Type Q9H4D7 (SEQ ID NO:1700):

1. An isolated chimeric polypeptide encoding for H53626_PEA_1_P5 (SEQ ID NO:325), comprising a first amino acid sequence being at least 90% homologous to MTPSPLLLLLLPPLLLGAFPPAAAARGP-PKMADKVVPRQVARLGRTVRLQCPVEGDPPP LTM-WTKDGRTIHSGWSRFRV-LPQGLKVKQVEREDAGVYVCKATNGFGSLSVN YTLVV LDDISPGKESLGPDSSSGGQEDPAS-QQWARPRFTQPSKMRRRVIARPVGSSVRLKCVAS GHPRPDITWMKDDQALTR-PEAAEPRKKKWTLSLKNLRPEDSGKYT-CRVSNRAGAINAT YKVDVIQRTRSKPVLTGTHPVNT-TVDFGGTTSFQCK corresponding to amino acids 1-269 of Q9H4D7 (SEQ ID NO:1700), which also corresponds to amino acids 1-269 of H53626_PEA_1_P5 (SEQ ID NO:325), and a second amino acid sequence being at least 70%, optionally at least 80%, preferably at least 85%, more preferably at least 90% and most preferably at least 95% homologous to a polypeptide having the sequence TQN-RQGHLWPPRPRPLACRGPWSSASQ-PALSSSWAPCSCGFARPRRSRAPPRLPLPCLG TAR-RGRPATAAETRTFPRWPPSALALVWGCVRSMGL RPPSTYWAQAQLLALSCTPNS TQTSTHTHTHTLTH-THTWRARSTSTSTISARRHRICSGHG-GAGQTGRLGGWRTELQTKA GDPWRGGMAST-PGSLCVRHSPWTHTHRHTHYLDACMHTHARTRAP (SEQ ID NO: 1776) corresponding to amino acids 270-490 of H53626_PEA_1_P5 (SEQ ID NO:325), wherein said first and second amino acid sequences are contiguous and in a sequential order.

2. An isolated polypeptide encoding for a tail of H53626_PEA_1_P5 (SEQ ID NO:325), comprising a polypeptide being at least 70%, optionally at least about 80%, preferably at least about 85%, more preferably at least about 90% and most preferably at least about 95% homologous to the sequence TQNRQGHLWPPRPRPLACRGPWSSASQ-PALSSSWAPCSCGFARPRRSRAPPRLPLPCLG TAR-RGRPATAAETRTFPRWPPSALA-LVWGCVRSMGLRQPPSTYWAQAQLLALSCTPNS TQTSTHTHTHTLTHTHTWRARSTSTSTI-SARRHRICSGHGGAGQTGRLGGWRTELQTKA GDP-WRGGMASTPGSLCVRHSPWTHTHRHTH-YLDACMHTHARTRAP (SEQ ID NO: 1776) in H53626_PEA_1_P5 (SEQ ID NO:325).

Comparison Report Between H53626_PEA_1_P5 (SEQ ID NO:325) and Wild Type Q8N441 (SEQ ID NO:1699):

1. An isolated chimeric polypeptide encoding for H53626_PEA_1_P5 (SEQ ID NO:325), comprising a first amino acid sequence being at least 90% homologous to MTPSPLLLLLLPPLLLGAFPPAAAARGP-PKMADKVVPRQVARLGRTVRLQCPVEGDPPP LTM-WTKDGRTIHSGWSRFRV-LPQGLKVKQVEREDAGVYVCKATNGFGSLSVNYT LVV LDDISPGKESLGPDSSSGGQEDPAS-QQWARPRFTQPSKMRRRVIARPVGSSVRLKCVAS GHPRPDITWMKDDQALTR-PEAAEPRKKKWTLSLKNLRPEDSGKYT-CRVSNRAGAINAT YKVDVIQRTRSKPVLTGTHPVNT-TVDFGGTTSFQCK corresponding to amino acids 1-269 of Q8N441 (SEQ ID NO:1699), which also corresponds to amino acids 1-269 of H53626_PEA_1_P5 (SEQ ID NO:325), and a second amino acid sequence being at least 70%, optionally at least 80%, preferably at least 85%, more preferably at least 90% and most preferably at least 95% homologous to a polypeptide having the sequence TQN-RQGHLWPPRPRPLACRGPWSSASQ-PALSSSWAPCSCGFARPRRSRAPPRLPLPCLG TAR-RGRPATAAETRTFPRWPPSALALVWGCVRSMGLR QPPSTYWAQAQLLALSCTPNS TQTSTHTHTHTLTH-THTWRARSTSTSTISARRHRICSGHG-GAGQTGRLGGWRTELQTKA GDPWRGGMAST-PGSLCVRHSPWTHTHRHTHYLDACMHTHARTRAP (SEQ ID NO: 1776) corresponding to amino acids 270-490 of H53626_PEA_1_P5 (SEQ ID NO:325), wherein said first and second amino acid sequences are contiguous and in a sequential order.

2. An isolated polypeptide encoding for a tail of H53626_PEA_1_P5 (SEQ ID NO:325), comprising a polypeptide being at least 70%, optionally at least about 80%, preferably at least about 85%, more preferably at least about 90% and most preferably at least about 95% homologous to the sequence TQNRQGHLWPPRPRPLACRGPWSSASQ-PALSSSWAPCSCGFARPRRSRAPPRLPLPCLG TAR-RGRPATAAETRTFPRWPPSALA-LVWGCVRSMGLRQPPSTYWAQAQLLALSCTPNS TQTSTHTHTHTLTHTHTWRARSTSTSTI-SARRHRICSGHGGAGQTGRLGGWRTELQTKA GDP-WRGGMASTPGSLCVRHSPWTHTHRHTH-YLDACMHTHARTRAP (SEQ ID NO: 1776) in H53626_PEA_1_P5 (SEQ ID NO:325).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H53626_PEA_1_P5 (SEQ ID NO:325) also has the following non-silent SNPs (Single Nucleotide Polymorphisms) as listed in Table 1328 (given according to their position(s) on the amino acid sequence, with the alternative amino acid(s) listed; the last column indicates whether the SNP is known or not; the presence of known SNPs in variant protein H53626_PEA_1_P5 (SEQ ID NO:325) sequence provides support for the deduced sequence of this variant protein according to the present invention).

TABLE 1328

Amino acid mutations

| SNP position(s) on amino acid sequence | Alternative amino acid(s) | Previously known SNP? |
|---|---|---|
| 193 | R -> L | Yes |
| 274 | Q -> K | Yes |
| 336 | A -> S | Yes |
| 353 | A -> | No |
| 376 | Q -> * | Yes |
| 405 | R -> G | No |
| 426 | G -> | No |
| 476 | Y -> C | Yes |

Variant protein H53626_PEA_1_P5 (SEQ ID NO:325) is encoded by the following transcript(s): H53626_PEA_1_T16 (SEQ ID NO:17), for which the sequence(s) is/are given at the end of the application. The coding portion of transcript H53626_PEA_1_T16 (SEQ ID NO:17) is shown in bold; this coding portion starts at position 17 and ends at position 1489. The transcript also has the following SNPs as listed in Table 1329 (given according to their position on the nucleotide sequence, with the alternative nucleic acid listed; the last column indicates whether the SNP is known or not; the presence of known SNPs in variant protein H53626_PEA_1_P5 (SEQ ID NO:325) sequence provides support for the deduced sequence of this variant protein according to the present invention).

TABLE 1329

Nucleic acid SNPs

| SNP position on nucleotide sequence | Alternative nucleic acid | Previously known SNP? |
|---|---|---|
| 76 | G -> A | Yes |
| 340 | G -> T | No |
| 1688 | C -> T | Yes |
| 1803 | C -> T | Yes |
| 1828 | C -> G | Yes |
| 2143 | C -> T | Yes |
| 2144 | G -> A | Yes |
| 2260 | C -> T | Yes |
| 2467 | G -> A | Yes |
| 2522 | C -> G | Yes |
| 594 | G -> T | Yes |
| 836 | C -> A | Yes |
| 1022 | G -> T | Yes |
| 1074 | C -> | No |
| 1142 | C -> T | Yes |
| 1229 | A -> G | No |
| 1292 | G -> | No |
| 1443 | A -> G | Yes |

As noted above, cluster H53626 features 20 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H53626_PEA_1_node_15 (SEQ ID NO:18) according to the present invention is supported by 25 libraries. The number of libraries was determined as previously described. This segment can be found in the following transcript(s): H53626_PEA_1_T15 (SEQ ID NO:16) and H53626_PEA_1_T16 (SEQ ID NO:17). Table 1330 below describes the starting and ending position of this segment on each transcript.

TABLE 1330

Segment location on transcripts

| Transcript name | Segment starting position | Segment ending position |
|---|---|---|
| H53626_PEA_1_T15 (SEQ ID NO: 16) | 96 | 343 |
| H53626_PEA_1_T16 (SEQ ID NO: 17) | 96 | 343 |

Segment cluster H53626_PEA_1_node_22 (SEQ ID NO:19) according to the present invention is supported by 42 libraries. The number of libraries was determined as previously described. This segment can be found in the following transcript(s): H53626_PEA_1_T15 (SEQ ID NO:16) and H53626_PEA_1_T16 (SEQ ID NO:17). Table 1332 below describes the starting and ending position of this segment on each transcript.

TABLE 1332

Segment location on transcripts

| Transcript name | Segment starting position | Segment ending position |
|---|---|---|
| H53626_PEA_1_T15 (SEQ ID NO: 16) | 450 | 734 |
| H53626_PEA_1_T16 (SEQ ID NO: 17) | 450 | 734 |

Segment cluster H53626_PEA_1_node_25 (SEQ ID NO:306) according to the present invention is supported by 41 libraries. The number of libraries was determined as previously described. This segment can be found in the following transcript(s): H53626_PEA_1_T15 (SEQ ID NO:16). Table 1334 below describes the starting and ending position of this segment on each transcript.

TABLE 1334

Segment location on transcripts

| Transcript name | Segment starting position | Segment ending position |
|---|---|---|
| H53626_PEA_1_T15 (SEQ ID NO: 16) | 824 | 1088 |

Segment cluster H53626_PEA_1_node_26 (SEQ ID NO:307) according to the present invention is supported by 5 libraries. The number of libraries was determined as previously described. This segment can be found in the following transcript(s): H53626_PEA_1_T15 (SEQ ID NO:16). Table 1336 below describes the starting and ending position of this segment on each transcript.

TABLE 1336

Segment location on transcripts

| Transcript name | Segment starting position | Segment ending position |
|---|---|---|
| H53626_PEA_1_T15 (SEQ ID NO: 16) | 1089 | 1328 |

Segment cluster H53626_PEA_1_node_27 (SEQ ID NO:308) according to the present invention is supported by 106 libraries. The number of libraries was determined as previously described. This segment can be found in the following transcript(s): H53626_PEA_1_T15 (SEQ ID NO:16) and H53626_PEA_1_T16 (SEQ ID NO:17). Table 1338 below describes the starting and ending position of this segment on each transcript.

TABLE 1338

Segment location on transcripts

| Transcript name | Segment starting position | Segment ending position |
|---|---|---|
| H53626_PEA_1_T15 (SEQ ID NO: 16) | 1329 | 2228 |
| H53626_PEA_1_T16 (SEQ ID NO: 17) | 824 | 1723 |

Segment cluster H53626_PEA_1_node_34 (SEQ ID NO:309) according to the present invention is supported by 121 libraries. The number of libraries was determined as previously described. This segment can be found in the following transcript(s): H53626_PEA_1_T15 (SEQ ID NO:16) and H53626_PEA_1_T16 (SEQ ID NO:17). Table 1340 below describes the starting and ending position of this segment on each transcript.

TABLE 1340

Segment location on transcripts

| Transcript name | Segment starting position | Segment ending position |
|---|---|---|
| H53626_PEA_1_T15 (SEQ ID NO: 16) | 2507 | 2977 |
| H53626_PEA_1_T16 (SEQ ID NO: 17) | 2002 | 2472 |

Segment cluster H53626_PEA_1_node_35 (SEQ ID NO:310) according to the present invention is supported by 85 libraries. The number of libraries was determined as previously described. This segment can be found in the following transcript(s): H53626_PEA_1_T15 (SEQ ID NO:16) and H53626_PEA_1_T16 (SEQ ID NO:17). Table 1342 below describes the starting and ending position of this segment on each transcript.

TABLE 1342

Segment location on transcripts

| Transcript name | Segment starting position | Segment ending position |
|---|---|---|
| H53626_PEA_1_T15 (SEQ ID NO: 16) | 2978 | 3148 |

TABLE 1342-continued

Segment location on transcripts

| Transcript name | Segment starting position | Segment ending position |
|---|---|---|
| H53626_PEA_1_T16 (SEQ ID NO: 17) | 2473 | 2643 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1343.

TABLE 1343

Oligonucleotides related to this segment

| Oligonucleotide name | Overexpressed in cancers | Chip reference |
|---|---|---|
| NA | | |

Segment cluster H53626_PEA_1_node_36 (SEQ ID NO:311) according to the present invention is supported by 69 libraries. The number of libraries was determined as previously described. This segment can be found in the following transcript(s): H53626_PEA_1_T15 (SEQ ID NO:16) and H53626_PEA_1_T16 (SEQ ID NO:17). Table 1344 below describes the starting and ending position of this segment on each transcript.

TABLE 1344

Segment location on transcripts

| Transcript name | Segment starting position | Segment ending position |
|---|---|---|
| H53626_PEA_1_T15 (SEQ ID NO: 16) | 3149 | 3322 |
| H53626_PEA_1_T16 (SEQ ID NO: 17) | 2644 | 2817 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 13455.

TABLE 1345

Oligonucleotides related to this segment

| Oligonucleotide name | Overexpressed in cancers | Chip reference |
|---|---|---|
| NA | | |

According to an optional embodiment of the present invention, short segments related to the above cluster are also provided. These segments are up to about 120 bp in length, and so are included in a separate description.

Segment cluster H53626_PEA_1_node_11 (SEQ ID NO:312) according to the present invention is supported by 12 libraries. The number of libraries was determined as previously described. This segment can be found in the following transcript(s): H53626_PEA_1_T15 (SEQ ID NO:16) and H53626_PEA_1_T16 (SEQ ID NO:17). Table 1346 below describes the starting and ending position of this segment on each transcript.

TABLE 1346

Segment location on transcripts

| Transcript name | Segment starting position | Segment ending position |
|---|---|---|
| H53626_PEA_1_T15 (SEQ ID NO: 16) | 1 | 55 |
| H53626_PEA_1_T16 (SEQ ID NO: 17) | 1 | 55 |

Segment cluster H53626_PEA_1_node_12 (SEQ ID NO:313) according to the present invention is supported by 11 libraries. The number of libraries was determined as previously described. This segment can be found in the following transcript(s): H153626_PEA_1_T15 (SEQ ID NO:16) and H53626_PEA_1_T16 (SEQ ID NO:17). Table 1347 below describes the starting and ending position of this segment on each transcript.

TABLE 1347

Segment location on transcripts

| Transcript name | Segment starting position | Segment ending position |
|---|---|---|
| H53626_PEA_1_T15 (SEQ ID NO: 16) | 56 | 95 |
| H53626_PEA_1_T16 (SEQ ID NO: 17) | 56 | 95 |

Segment cluster H53626_PEA_1_node_16 (SEQ ID NO:314) according to the present invention can be found in the following transcript(s): H53626_PEA_1_T15 (SEQ ID NO:16) and H53626_PEA_1_T16 (SEQ ID NO:17). Table 1348 below describes the starting and ending position of this segment on each transcript.

TABLE 1348

Segment location on transcripts

| Transcript name | Segment starting position | Segment ending position |
|---|---|---|
| H53626_PEA_1_T15 (SEQ ID NO: 16) | 344 | 368 |
| H53626_PEA_1_T16 (SEQ ID NO: 17) | 344 | 368 |

Segment cluster H53626_PEA_1_node_19 (SEQ ID NO:315) according to the present invention is supported by 25 libraries. The number of libraries was determined as previously described. This segment can be found in the following transcript(s): H53626_PEA_1_T15 (SEQ ID NO:16) and H53626_PEA_1_T16 (SEQ ID NO:17). Table 1349 below describes the starting and ending position of this segment on each transcript.

TABLE 1349

Segment location on transcripts

| Transcript name | Segment starting position | Segment ending position |
|---|---|---|
| H53626_PEA_1_T15 (SEQ ID NO: 16) | 369 | 419 |
| H53626_PEA_1_T16 (SEQ ID NO: 17) | 369 | 419 |

Segment cluster H53626_PEA_1_node_20 (SEQ ID NO:316) according to the present invention is supported by 27 libraries. The number of libraries was determined as previously described. This segment can be found in the following transcript(s): H53626_PEA_1_T15 (SEQ ID NO:16) and H53626_PEA_1_T16 (SEQ ID NO:17). Table 1350 below describes the starting and ending position of this segment on each transcript.

TABLE 1350

Segment location on transcripts

| Transcript name | Segment starting position | Segment ending position |
|---|---|---|
| H53626_PEA_1_T15 (SEQ ID NO: 16) | 420 | 449 |
| H53626_PEA_1_T16 (SEQ ID NO: 17) | 420 | 449 |

Segment cluster H53626_PEA_1_node_24 (SEQ ID NO:317) according to the present invention is supported by 34 libraries. The number of libraries was determined as previously described. This segment can be found in the following transcript(s): H53626_PEA_1_T115 (SEQ ID NO:16) and H53626_PEA_1_T16 (SEQ ID NO:17). Table 1351 below describes the starting and ending position of this segment on each transcript.

TABLE 1351

Segment location on transcripts

| Transcript name | Segment starting position | Segment ending position |
|---|---|---|
| H53626_PEA_1_T15 (SEQ ID NO: 16) | 735 | 823 |
| H53626_PEA_1_T16 (SEQ ID NO: 17) | 735 | 823 |

Segment cluster H53626_PEA_1_node_28 (SEQ ID NO:318) according to the present invention is supported by 66 libraries. The number of libraries was determined as previously described. This segment can be found in the following transcript(s): H53626_PEA_1_T15 (SEQ ID NO:16) and H53626_PEA_1_T16 (SEQ ID NO:17). Table 1352 below describes the starting and ending position of this segment on each transcript.

TABLE 1352

Segment location on transcripts

| Transcript name | Segment starting position | Segment ending position |
|---|---|---|
| H53626_PEA_1_T15 (SEQ ID NO: 16) | 2229 | 2306 |

TABLE 1352-continued

Segment location on transcripts

| Transcript name | Segment starting position | Segment ending position |
|---|---|---|
| H53626_PEA_1_T16 (SEQ ID NO: 17) | 1724 | 1801 |

Segment cluster H53626_PEA_1_node_29 (SEQ ID NO:319) according to the present invention is supported by 73 libraries. The number of libraries was determined as previously described. This segment can be found in the following transcript(s): H53626_PEA_1_T15 (SEQ ID NO:16) and H53626_PEA_1_T16 (SEQ ID NO:17). Table 1353 below describes the starting and ending position of this segment on each transcript.

TABLE 1353

Segment location on transcripts

| Transcript name | Segment starting position | Segment ending position |
|---|---|---|
| H53626_PEA_1_T15 (SEQ ID NO: 16) | 2307 | 2396 |
| H53626_PEA_1_T16 (SEQ ID NO: 17) | 1802 | 1891 |

Segment cluster H53626_PEA_1_node_30 (SEQ ID NO:320) according to the present invention is supported by 71 libraries. The number of libraries was determined as previously described. This segment can be found in the following transcript(s): H53626_PEA_1_T15 (SEQ ID NO:16) and H53626_PEA_1_T16 (SEQ ID NO:17). Table 1354 below describes the starting and ending position of this segment on each transcript.

TABLE 1354

Segment location on transcripts

| Transcript name | Segment starting position | Segment ending position |
|---|---|---|
| H53626_PEA_1_T15 (SEQ ID NO: 16) | 2397 | 2442 |
| H53626_PEA_1_T16 (SEQ ID NO: 17) | 1892 | 1937 |

Segment cluster H53626_PEA_1_node_31 (SEQ ID NO:321) according to the present invention is supported by 67 libraries. The number of libraries was determined as previously described. This segment can be found in the following transcript(s): H53626_PEA_1_T15 (SEQ ID NO:16) and H53626_PEA_1_T16 (SEQ ID NO:17). Table 1355 below describes the starting and ending position of this segment on each transcript.

TABLE 1355

Segment location on transcripts

| Transcript name | Segment starting position | Segment ending position |
|---|---|---|
| H53626_PEA_1_T15 (SEQ ID NO: 16) | 2443 | 2469 |

TABLE 1355-continued

Segment location on transcripts

| Transcript name | Segment starting position | Segment ending position |
|---|---|---|
| H53626_PEA_1_T16 (SEQ ID NO: 17) | 1938 | 1964 |

Segment cluster H53626_PEA_1_node_32 (SEQ ID NO:322) according to the present invention is supported by 65 libraries. The number of libraries was determined as previously described. This segment can be found in the following transcript(s): H53626_PEA_1_T15 (SEQ ID NO:16) and H53626_PEA_1_T16 (SEQ ID NO:17). Table 1356 below describes the starting and ending position of this segment on each transcript.

TABLE 1356

Segment location on transcripts

| Transcript name | Segment starting position | Segment ending position |
|---|---|---|
| H53626_PEA_1_T15 (SEQ ID NO: 16) | 2470 | 2498 |
| H53626_PEA_1_T16 (SEQ ID NO: 17) | 1965 | 1993 |

Segment cluster H53626_PEA_1_node_33 (SEQ ID NO:323) according to the present invention can be found in the following transcript(s): H53626_PEA_1_T15 (SEQ ID NO:16) and H53626_PEA_1_T16 (SEQ ID NO:17). Table 1357 below describes the starting and ending position of this segment on each transcript.

TABLE 1357

Segment location on transcripts

| Transcript name | Segment starting position | Segment ending position |
|---|---|---|
| H53626_PEA_1_T15 (SEQ ID NO: 16) | 2499 | 2506 |
| H53626_PEA_1_T16 (SEQ ID NO: 17) | 1994 | 2001 |

Variant Protein Alignment to the Previously Known Protein:

Sequence name: /tmp/K1Mec2ReKO/eg1EUS2AXY: Q8N441 (SEQ ID NO:1699)

Sequence documentation:

Alignment of: H53626_PEA_1_P4 (SEQ ID NO:324) x Q8N441 (SEQ ID NO:1699) ..

Alignment segment 1/1:

| | | | |
|---|---|---|---|
| Quality: | 4882.00 | Escore: | 0 |
| Matching length: | 504 | Total length: | 584 |
| Matching Percent Similarity: | 100.00 | Matching Percent Identity: | 100.00 |
| Total Percent Similarity: | 86.30 | Total Percent Identity: | 86.30 |
| Gaps: | 1 | | |

Alignment:

```
  1 MTPSPLLLLLLPPLLIGAFPPAAAARGPPKMADKVVPRQVARLGRTVRLQ    50
    ||||||||||||||| ||||||||||||||||||||||||||||||||||
  1 MTPSPLLLLLLPPLLLGAFPPAAAARGPPKMADKVVPRQVARLGRTVRLQ    50

51 CPVEGDPPPLTMWTKDGRTIHSGWSRFRVLPQGLKVKQVEREDAGVYVCK   100
    ||||||||||||||||||||||||||||||||||||||||||||||||||
 51 CPVEGDPPPLTMWTKDGRTIHSGWSRFRVLPQGLKVKQVEREDAGVYVCK   100

101 ATNGFGSLSVNYTLVVLDDISPGKESLGPDSSSGGQEDPASQQWARPRFT   150
    ||||||||||||||||||||||||||||||||||||||||||||||||||
101 ATNGFGSLSVNYTLVVLDDISPGKESLGPDSSSGGQEDPASQQWARPRFT   150

151 QPSKMRRRVIARPVGSSVRLKCVASGHPRPDITWMKDDQALTRPEAAEPR   200
    ||||||||||||||||||||||||||||||||||||||||||||||||||
151 QPSKMRRRVIARPVGSSVRLKCVASGHPRPDITWMKDDQALTRPEAAEPR   200

201 KKKWTLSLKNLRPEDSGKYTCRVSNRAGAINATYKVDVIQRTRSKPVLTG   250
    ||||||||||||||||||||||||||||||||||||||||||||||||||
201 KKKWTLSLKNLRPEDSGKYTCRVSNRAGAINATYKVDVIQRTRSKPVLTG   250

251 THPVNTTVDFGGTTSFQCKVRSDVKPVIQWLKRVEYGAEGRHNSTIDVGG   300
    |||||||||| ||||||||||||| |||||||||||||||||||||||||
251 THPVNTTVDEGGTTSFQCKVRSDVDPVIQWLKRVEYGAEGRHNSTIDVGG   300

301 QKFVVLPTGDVWSRPDGSYLNKLLITRARQDDAGMYICLGANTMGYSFRS   350
    ||||||||||||||||||||||||||||||||||||||||||||||||||
301 QKFVVLPTGDVWSRPDGSYLNKLLITRARQDDAGMYICLGANTMGYSFRS   350

351 AFLTVLPGARLPRHATPCWCPDPPPGPGVPPTGWGPTLPSRAVLARSSAE   400
    |||||||
351 AFLTVLP...........................................   357

401 GGQPRGTVSTAPGMGLGCSPGLCVGVPLPTSFPLALADPKPPGPPVASSS   450
                                         |||||||||||||||
358 ..................................DPKPPGPPVASSS    370

451 SATSLPWPVVIGIPAGAVFILGTLLLWLCQAQKKPCTPAPAPPLPGHRPP   500
    ||||||||||||||||||||||||||||||||||||||||||||||||||
371 SATSLPWPVVIGIPAGAVFILGTLLLWLCQAQKKPCTPAPAPPLPGHRPP   420

501 GTARDRSGDKDLPSLAALSAGPGVGLCEEHGSPAAPQHLLGPGPVAGPKL   550
    ||||||||||||||||||||||||||||||||||||||||||||||||||
421 GTARDRSGDKDLPSLAALSAGPGVGLCEEHGSPAAPQHLLGPGPVAGPKL   470

551 YPKLYTDIHTHTHTHSHTHSHVEGKVHQIHYQC    584
    ||||||||||||||||||||||||||||||||
471 YPKLYTDIHTHTHTHSHTHSHVEGKVHQIHYQC    504
```

Sequence name: /tmp/oSUZaRW3WK/oSh3fN5Zt0:
Q9H4D7 (SEQ ID NO:1700)
Sequence documentation:
Alignment of: H53626_PEA_1_P5 (SEQ ID NO:325) x
Q9H4D7 (SEQ ID NO:1700) ..
Alignment segment 1/1:

| | | | |
|---|---|---|---|
| Quality: | 2644.00 | Escore: | 0 |
| Matching length: | 269 | Total length: | 269 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MTPSPLLLLLLPPLLIGAFPPAAAARGPPKMADKVVPRQVARLGRTVRLQ   50
     ||||||||||||||||||||||||||||||||||||||||||||||||||
  1  MTPSPLLLLLLPPLLLGAFPPAAAARGPPKMADKVVPRQVARLGRTVRLQ   50

51  CPVEGDPPPLTMWTKDGRTIHSGWSRFRVLPQGLKVKQVEREDAGVYVCK  100
     ||||||||||||||||||||||||||||||||||||||||||||||||||
 51  CPVEGDPPPLTMWTKDGRTIHSGWSRFRVLPQGLKVKQVEREDAGVYVCK  100

101  ATNGFGSLSVNYTLVVLDDISPGKESLGPDSSSGGQEDPASQQWARPRFT  150
     ||||||||||||||||||||||||||||||||||||||||||||||||||
101  ATNGFGSLSVNYTLVVLDDISPGKESLGPDSSSGGQEDPASQQWARPRFT  150

151  QPSKMRRRVIARPVGSSVRLKCVASGHPRPDITWMKDDQALTRPEAAEPR  200
     ||||||||||||||||||||||||||||||||||||||||||||||||||
151  QPSKMRRRVIARPVGSSVRLKCVASGHPRPDITWMKDDQALTRPEAAEPR  200

201  KKKWTLSLKNLRPEDSGKYTCRVSNRAGAINATYKVDVIQRTRSKPVLTG  250
     ||||||||||||||||||||||||||||||||||||||||||||||||||
201  KKKWTLSLKNLRPEDSGKYTCRVSNRAGAINATYKVDVIQRTRSKPVLTG  250

251  THPVNTTVDFGGTTSFQCK                                 269
     |||||||||| ||||||||
251  THPVNTTVDEGGTTSFQCK                                 269
```

Sequence name: /tmp/oSUZaRW3WK/oSh3fN5Zt0:
Q8N441 (SEQ ID NO:1699)
Sequence documentation:
Alignment of: H53626_PEA_1_P5 (SEQ ID NO:325) x
Q8N441 (SEQ ID NO:1699) ..
Alignment segment 1/1:

| | | | |
|---|---|---|---|
| Quality: | 2644.00 | Escore: | 0 |
| Matching length: | 269 | Total length: | 269 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MTPSPLLLLLLPPLLIGAFPPAAAARGPPKMADKVVPRQVARLGRTVRLQ   50
     ||||||||||||||||||||||||||||||||||||||||||||||||||
  1  MTPSPLLLLLLPPLLLGAFPPAAAARGPPKMADKVVPRQVARLGRTVRLQ   50

51  CPVEGDPPPLTMWTKDGRTIHSGWSRFRVLPQGLKVKQVEREDAGVYVCK  100
     ||||||||||||||||||||||||||||||||||||||||||||||||||
 51  CPVEGDPPPLTMWTKDGRTIHSGWSRFRVLPQGLKVKQVEREDAGVYVCK  100
```

```
-continued
101  ATNGFGSLSVNYTLVVLDDISPGKESLGPDSSSGGQEDPASQQWARPRFT  150
     ||||||||||||||||||||||||||||||||||||||||||||||||||
101  ATNGFGSLSVNYTLVVLDDISPGKESLGPDSSSGGQEDPASQQWARPRFT  150

151  QPSKMRRRVIARPVGSSVRLKCVASGHPRPDITWMKDDQALTRPEAAEPR  200
     |||||||||||||||||||||||||||||||||||||||||||||||||
151  QPSKMRRRVIARPVGSSVRLKCVASGHPRPDITWMKDDQALTRPEAAEPR  200

201  KKKWTLSLKNLRPEDSGKYTCRVSNRAGAINATYKVDVIQRTRSKPVLTG  250
     ||||||||||||||||||||||||||||||||||||||||||||||||||
201  KKKWTLSLKNLRPEDSGKYTCRVSNRAGAINATYKVDVIQRTRSKPVLTG  250

251  THPVNTTVDFGGTTSFQCK                                269
     |||||||||| |||||||
251  THPVNTTVDEGGTTSFQCK                                269
```

Expression of *Homo sapiens* Fibroblast Growth Factor Receptor-like 1 (FGFRL1) H53626 Transcripts, which are Detectable by Amplicon as Depicted in Sequence Name H53626 Junc24-27F1R3 (SEQ ID NO:1690) in Normal and Cancerous Lung Tissues Expression of *Homo sapiens* fibroblast growth factor receptor-like 1 (FGFRL1) transcripts detectable by or according to junc24-27, H53626 junc24-27F1R3 amplicon (SEQ ID NO: 1690) and H53626 junc24-27F1 (SEQ ID NO:1688) and H53626 junc24-27R3 (SEQ ID NO: 1689) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 74:
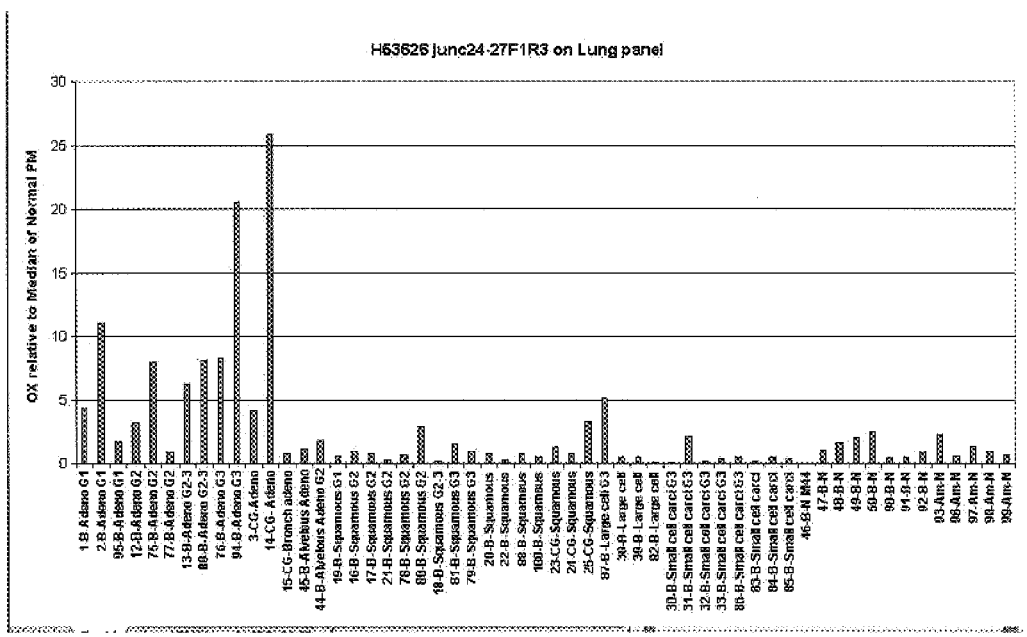
FIG. 74 is a histogram showing over expression of the *Homo sapiens* fibroblast growth factor receptor-like 1 (FGFRL1) H53626 transcripts, which are detectable by amplicon as depicted in sequence name H53626 junc24-27F1R3 (SEQ ID NO:1690) in cancerous lung samples relative to the normal samples.

FIG. 74 is a histogram showing over expression of the above-indicated *Homo sapiens* fibroblast growth factor receptor-like 1 (FGFRL1) transcripts in cancerous lung samples relative to the normal samples.

As is evident from FIG. 74, the expression of *Homo sapiens* fibroblast growth factor receptor-like 1 (FGFRL1) transcripts detectable by the above amplicon(s) was higher in several cancer samples than in the non-cancerous samples (Sample Nos. 46-50, 90-93, 96-99 Table 2). Notably an over-expression of at least 5 fold was found in 7 out of 15 adenocarcinoma samples.

Primer pairs are also optionally and preferably encompassed within the present invention; for example, for the above experiment, the following primer pair was used as a non-limiting illustrative example only of a suitable primer pair: H53626 junc24-27F1 forward primer (SEQ ID NO: 1688); and H53626 junc24-27R3 reverse primer (SEQ ID NO: 1689).

The present invention also preferably encompasses any amplicon obtained through the use of any suitable primer pair; for example, for the above experiment, the following amplicon was obtained as a non-limiting illustrative example only of a suitable amplicon: H53626 junc24-27F1R3 (SEQ ID NO: 1690).

```
Forward primer:  (SEQ ID NO: 1688)
GTCCTTCCAGTGCAAGACCCA

Reverse primer:  (SEQ ID NO: 1689)
TGGGCCTGGCAAAGCC

Amplicon:        (SEQ ID NO: 1690)
GTCCTTCCAGTGCAAGACCCAAAACCGCCAGGGCCACCTGTGGCCTCCTCGTCCTC

GGCCACTAGCCTGCCGTGGCCCGTGGTCATCGGCATCCCAGCCGGCGCTGTCTTCAT

CCTGGGCACCCTGCTCCTGTGGCTTTGCCAGGCCCA
```

Expression of *Homo sapiens* Fibroblast Growth Factor Receptor-like 1 (FGFRL1) H53626 Transcripts, which are Detectable by Amplicon as Depicted in Sequence Name H53626 seg25 (SEQ ID NO:1693) in Normal and Cancerous Lung Tissues Expression of *Homo sapiens* fibroblast growth factor receptor-like 1 (FGFRL1) transcripts detectable by or according to seg25, H53626 seg25 amplicon (SEQ ID NO:1693) and H53626 seg25F (SEQ ID NO:1691) and H53626 seg25R (SEQ ID NO:1692) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 75:
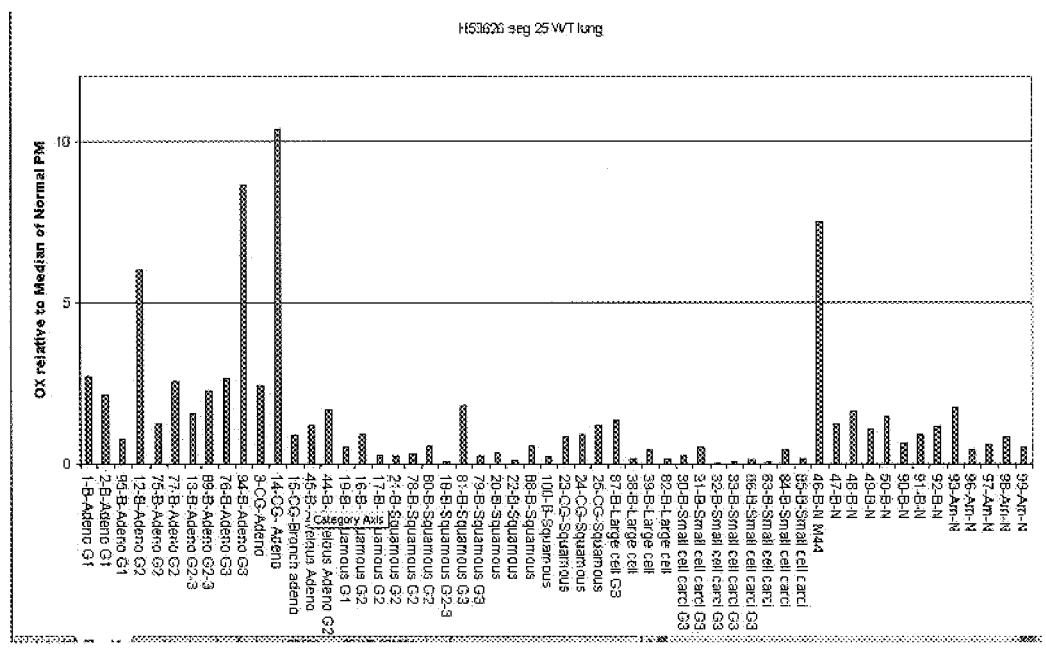
FIG. 75 is a histogram showing the expression of the *Homo sapiens* fibroblast growth factor receptor-like 1 (FGFRL1) H53626 transcripts, which are detectable by amplicon as depicted in sequence name H53626 seg25 (SEQ ID NO:1693) in cancerous lung samples relative to the normal samples.

As is evident from FIG. 75, the expression of Homo sapiens fibroblast growth factor receptor-like 1 (FGFRL1) transcripts detectable by the above amplicon(s) was higher in a few cancer samples than in the non-cancerous samples (Sample Nos. 46-50, 90-93, 96-99 Table 2). Notably an over-expression of at least 5 fold was found in 3 out of 15 adenocarcinoma samples.

Primer pairs are also optionally and preferably encompassed within the present invention; for example, for the above experiment, the following primer pair was used as a non-limiting illustrative example only of a suitable primer pair: H53626 seg25F forward primer (SEQ ID NO: 1691); and H53626 seg25R reverse primer (SEQ ID NO: 1692).

The present invention also preferably encompasses any amplicon obtained through the use of any suitable primer pair; for example, for the above experiment, the following amplicon was obtained as a non-limiting illustrative example only of a suitable amplicon: H53626 seg25 (SEQ ID NO: 1693).

```
Forward primer;  (SEQ ID NO: 1691)
CCGACGGCTCCTACCTCAA

Reverse primer:  (SEQ ID NO: 1692)
GGAAGCTGTAGCCCATGGTGT

Amplicon:        (SEQ ID NO: 1693)
CCGACGGCTCCTACCTCAATAAGCTGCTCATCACCCGTGCCCGCCAGGACGATGCG

GGCATGTACATCTGCCTTGGCGCCAACACCATGGGCTACAGCTTCC
```

Expression of Homo sapiens Fibroblast Growth Factor Receptor-like 1 (FGFRL1) H53626 Transcripts, which are Detectable by Amplicon as Depicted in Sequence Name H53626 seg25 (SEQ ID NO:1693) in Different Normal Tissues Expression of Homo sapiens fibroblast growth factor receptor-like 1 (FGFRL1) transcripts detectable by or according to H53626 seg25 amplicon (SEQ ID NO: 1693) and H53626 seg25F (SEQ ID NO: 1691) and H53626 seg25R (SEQ ID NO: 1692) was measured by real time PCR. In parallel the expression of four housekeeping genes: RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17 Table 3 above), to obtain a value of relative expression of each sample relative to median of the lung samples.

```
Forward primer;  (SEQ ID NO: 1691)
CCGACGGCTCCTACCTCAA

Reverse primer:  (SEQ ID NO: 1692)
GGAAGCTGTAGCCCATGGTGT

Amplicon:        (SEQ ID NO: 1693)
CCGACGGCTCCTACCTCAATAAGCTGCTCATCACCCGTGCCCGCCAGGACGATGCG

GGCATGTACATCTGCCTTGGCGCCAACACCATGGGCTACAGCTTCC
```

Figure 77:
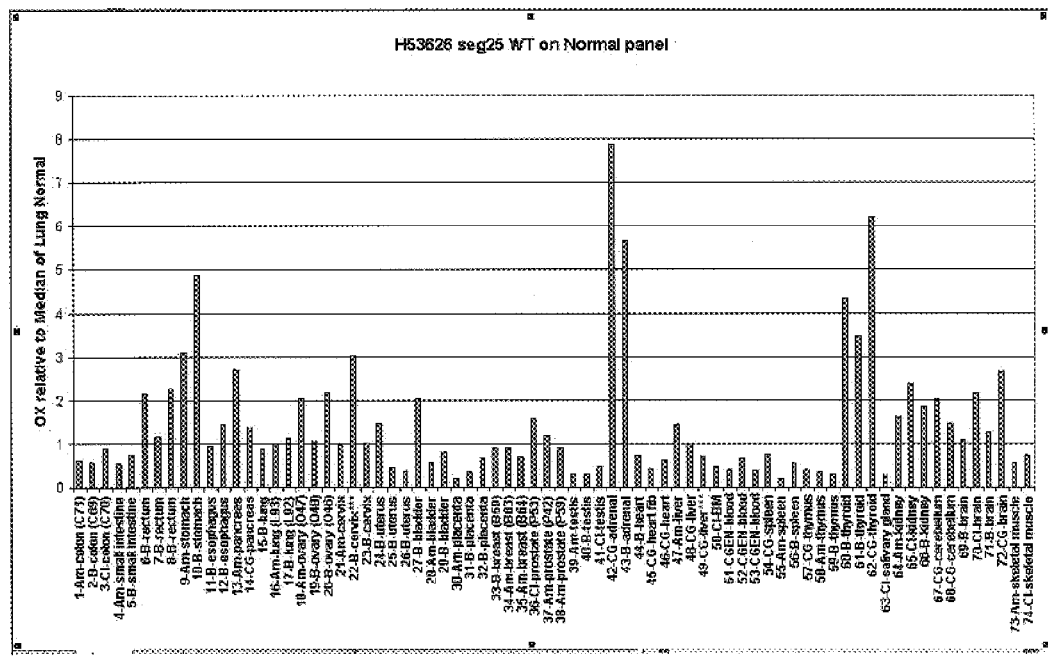
FIG. 77 is a histogram showing the expression of of *Homo sapiens* fibroblast growth factor receptor-like 1 (FGFRL1) H53626 transcripts, which are detectable by amplicon as depicted in sequence name H53626 seg25 (SEQ ID NO:1693) in different normal tissues.

The results are demonstrated in FIG. 77, showing the expression of of Homo sapiens fibroblast growth factor receptor-like 1 (FGFRL1) H53626 transcripts, which are detectable by amplicon as depicted in sequence name H53626 seg25 (SEQ ID NO: 1693) in different normal tissues.

Expression of Homo sapiens Fibroblast Growth Factor Receptor-like 1 (FGFRL1) H53626 Transcripts which are Detectable by Amplicon as Depicted in Sequence Name H53626 Junc24-27F1R3 (SEQ ID NO:1690) in Different Normal Tissues Expression of Homo sapiens fibroblast growth factor receptor-like 1 (FGFRL1) transcripts detectable by or according to H53626 junc24-27F1R3 amplicon (SEQ ID NO: 1690) and H53626 junc24-27F1 (SEQ ID NO: 1688) and H53626 junc24-27R3 (SEQ ID NO:1689) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633; primers SEQ ID NOs 1631 and 1632), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17 Table 3 above), to obtain a value of relative expression of each sample relative to median of the lung samples.

```
Forward primer:  (SEQ ID NO: 1688)
GTCCTTCCAGTGCAAGACCCA

Reverse primer:  (SEQ ID NO: 1689)
TGGGCCTGGCAAAGCC

Amplicon:        (SEQ ID NO: 1690)
GTCCTTCCAGTGCAAGACCCAAAACCGCCAGGGCCACCTGTGGCCTCCTCGTCCTC

GGCCACTAGCCTGCCGTGGCCCGTGGTCATCGGCATCCCAGCCGGCGCTGTCTTCAT

CCTGGGCACCCTGCTCCTGTGGCTTTGCCAGGCCCA
```

Figure 78:
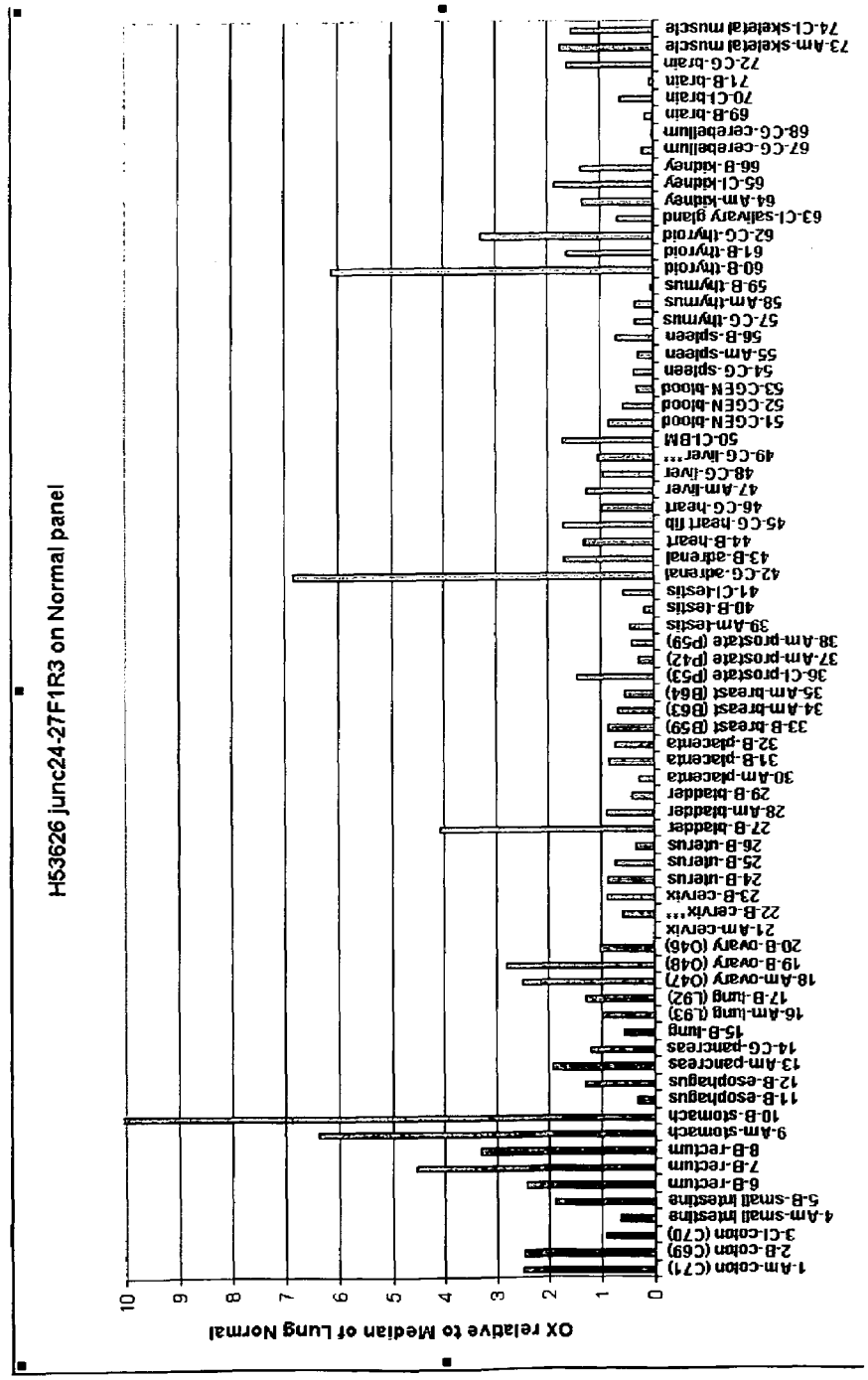
FIG. 78 is a histogram showing the expression of of *Homo sapiens* fibroblast growth factor receptor-like 1 (FGFRL1) H53626 transcripts, which are detectable by amplicon as depicted in sequence name H53626junc24-27F1R3 (SEQ ID NO:1690) in different normal tissues.

The results are demonstrated in FIG. 78, showing the expression of Homo sapiens fibroblast growth factor receptor-like 1 (FGFRL1) H53626 transcripts, which are detectable by amplicon as depicted in sequence name H53626junc24-27F1R3 (SEQ ID NO: 1690) in different normal tissues.

Expression of Trophinin Associated Protein (Tastin) [T86235] Transcripts which are Detectable by Amplicon as Depicted in SEQ ID NO:1480 in Normal and Cancerous Lung Tissues Expression of trophinin associated protein (tastin) transcripts detectable by SEQ ID NO:1480 (e.g., variant no. 23-26 31, 32—represented by SEQ IDs 1485-1488, 1609, 1610) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1480 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 54A:
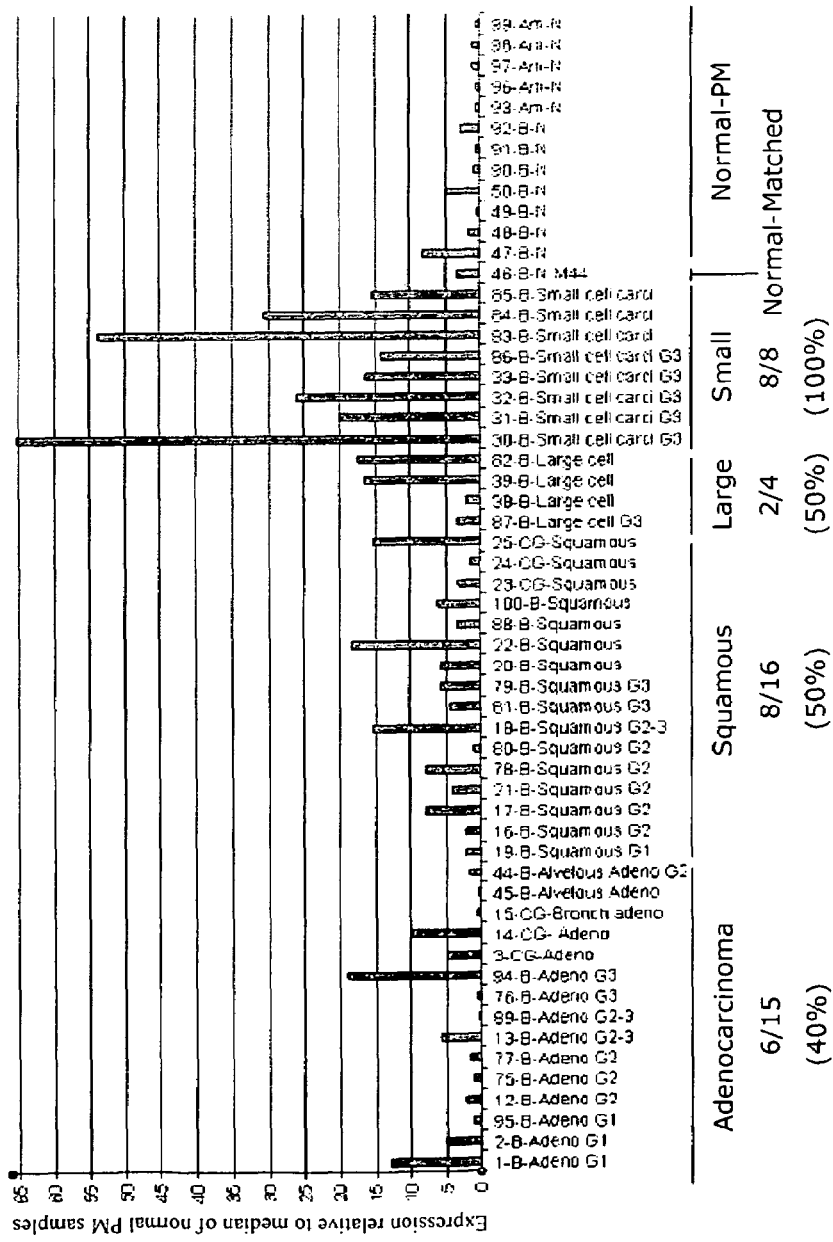
FIG. 54a is a histogram showing the relative expression of trophinin associated protein (tastin)) [T86235] variants (e.g., variant no. 23-26, 31, 32) in normal and tumor derived lung samples as determined by real time PCR using primers for SEQ ID NO: 1480.

FIG. 54a is a histogram showing over expression of the above-indicated trophinin associated protein (tastin) transcripts in cancerous lung samples relative to the normal samples. The number and percentage of samples that exhibit at least 5 fold over-expression, out of the total number of samples tested is indicated in the bottom.

As is evident from FIG. 54a, the expression of trophinin associated protein (tastin) transcripts detectable by SEQ ID NO:1480 in cancer samples was significantly higher than in the non-cancerous samples (Sample Nos. 46-50, 90-93, 96-99 Table 2, "Tissue samples in testing panel"). Notably an over-expression of at least 5 fold was found in 6 out of 15 adenocarcinoma samples, 8 out of 16 squamous cell carcinoma samples, 2 out of 4 large cell carcinoma samples and in 8 out of 8 small cells carcinoma samples.

Statistical analysis was applied to verify the significance of these results, as described below.

The P value for the difference in the expression levels of trophinin associated protein (tastin) transcripts detectable by SEQ ID NO:1480 in lung cancer samples versus the normal lung samples was determined by T test as 1.61E-04.

Threshold of 5 fold overexpression was found to differentiate between cancer and normal samples with P value of 1.49E-02 as checked by exact fisher test. The above values demonstrate statistical significance of the results.

According to the present invention, trophinin associated protein (tastin) is a non-limiting example of a marker for diagnosing lung cancer. The trophinin associated protein (tastin) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to trophinin associated protein (tastin) as previously defined is also encompassed within the present invention. Primer pairs are also optionally and preferably encompassed within the present invention; for example, for the above experiment, the following primer pair was used as a non-limiting illustrative example only of a suitable primer pair: trophinin associated protein (tastin)-TAA-seg 44-forward primer (SEQ ID NO: 1478): AGACTCCAACCCA-CAGCCC; and trophinin associated protein (tastin)-TAA-seg 44-Reverse primer (SEQ ID NO: 1479): CAGCTCAGC-CAACCTTGCA.

The present invention also preferably encompasses any amplicon obtained through the use of any suitable primer pair; for example, for the above experiment, the following amplicon was obtained as a non-limiting illustrative example only of a suitable amplicon: trophinin associated protein (tastin) amplicon, SEQ ID NO: 1480:

AGACTCCAACCCACAGCCCAGCTGTGGCTGCACAGTGAGCCTGATGGGAGGTGGGG

AACAGGGACAGGGGGCCACCTGGGCTTCTTCACAGAGAGGTCAGCAGGAAGGCTT

GGCTACAGTGCAAGGTTGGCTGAGCTG

According to other preferred embodiments of the present invention, trophinin associated protein (tastin) or a fragment thereof comprises a biomarker for detecting lung cancer. Optionally and more preferably, trophinin associated protein (tastin) splice variants, as depicted in SEQ ID NO: 1485-1488, 1609, 1610 (e.g., variant no. 23-26, 31, 32), or a fragment thereof comprise a biomarker for detecting lung cancer. Optionally and more preferably, the fragment of trophinin associated protein (tastin) comprises segment_TAA-44—SEQ ID NO: 1507. Also optionally and more preferably, any suitable method may be used for detecting a fragment such as trophinin associated protein (tastin)_segment_TAA-44—SEQ ID no 1507 for example. Most preferably, NAT-based technology used, such as any nucleic acid molecule capable of specifically hybridizing with the fragment. Optionally and most preferably, a primer pair is used for obtaining the fragment.

According to still other preferred embodiments, the present invention optionally and preferably encompasses any amino acid sequence or fragment thereof encoded by a nucleic acid sequence corresponding to trophinin associated protein (tastin) as described above, including but not limited to SEQ ID NOs: 1492-1501, 1612. Any oligopeptide or peptide relating to such an amino acid sequence or fragment thereof may optionally also (additionally or alternatively) be used as a biomarker, including but not limited to the unique amino acid sequences of these proteins that are depicted in SEQ ID Nos: 1508-1511, 1613. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to trophinin associated protein (tastin) as described above, optionally for any application.

Expression of Trophinin Associated Protein (Tastin) [T86235] Transcripts which are Detectable by Oligonucleotides as Depicted in SEQ ID NOs:1512-1514 in Normal and Cancerous Lung Tissues Expression of trophinin associated protein (tastin) [T86235] transcripts detectable by oligonucleotides SEQ ID NOs: 1512-1514 (e.g., variants no. 8-10, 22, 23, 26, 27, 29-31, 33-represented by SEQ IDs 1481-1485, 1488-1491, 1609, 1611) was measured with oligonucleotide-based micro-arrays. The segments detected by the above oligonucleotides as depicted in SEQ ID NOs: 1512-1514 are for example nucleotide sequences as depicted in SEQ IDs 1503, 1504, 1506.

The results of image intensities for each feature were normalized according to the ninetieth percentile of the image intensities of all the features on the chip. Then, feature image intensities for replicates of the same oligonucleotide on the chip and replicates of the same sample were averaged. Outlying results were discarded.

Figure 54B:
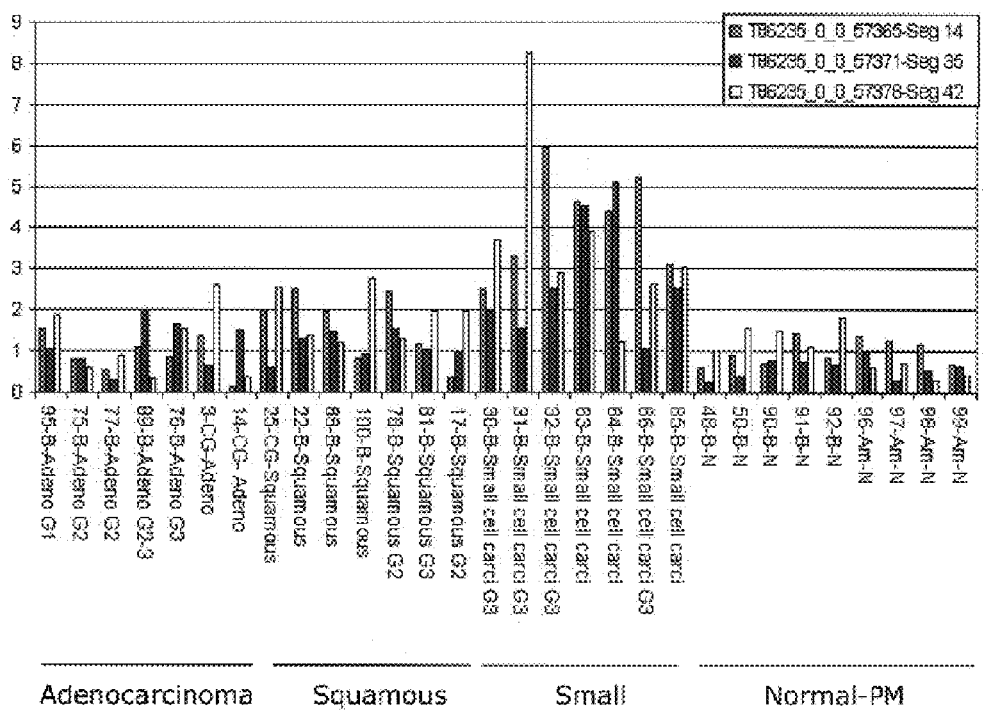
FIG. 54b is a histogram showing the relative expression of trophinin associated protein (tastin)) [T86235] variants (e.g., variant no. 8-10, 22, 23, 26, 27, 29-31, 33) in normal and tumor derived lung samples as determined micro-array analysis using oligos detailed in SEQ ID NO: 1512-1514.

For every oligonucleotide (SEQ ID NOs: 1512-1514) the averaged intensity determined for every sample was divided by the averaged intensity of all the normal samples (Sample Nos. 48, 50, 90-92, 96-99, Table 2, "Tissue samples in testing panel", above), to obtain a value of fold up-regulation for each sample relative to the averaged normal samples. These data are presented in a histogram in FIG. 54b. As is evident from FIG. 54b, the expression of trophinin associated protein (tastin) [T86235] transcripts detectable with oligonucleotides according to SEQ ID NOs: 1512-1514 in cancer samples was significantly higher than in the normal samples.

According to the present invention, trophinin associated protein (tastin) is a non-limiting example of a marker for diagnosing lung cancer. Although optionally any method may be used to detected overexpression and/or differential expression of this marker, preferably a NAT-based technology is used. Therefore, optionally and preferably, any nucleic acid molecule capable of selectively hybridizing to trophinin associated protein (tastin) as previously defined is also encompassed within the present invention. Oligonucleotides are also optionally and preferably encompassed within the present invention; for example, for the above experiment, the following oligonucleotides were used as a non-limiting illustrative example only of a suitable oligonucleotides: SEQ ID NOs: 1512-1514

SEQ ID 1512:
CATGGTAACACGGCCTCCATGGCTGAGTAGGGGACTAGGAAGGGTAAAAG

SEQ ID 1513:
TGTACATCTAGGGCCTCTCAGTTAGGGGCTTCAATCCATTCCTCATGAGG

SEQ ID 1514:
TGTGAACACAAGAGGTCCTCACCTCACTGTGAGCTGCACACCTGCCCTGC

According to other preferred embodiments of the present invention, trophinin associated protein (tastin) or a fragment thereof comprises a biomarker for detecting lung cancer. Optionally and more preferably, trophinin associated protein (tastin) splice variants, as depicted in SEQ ID NO:1481-1485, 1488-1491, 1609, 1611 (e.g., variant no. 8-10, 22, 23, 26, 27, 29-31, 33), or a fragment thereof comprise a biomarker for detecting lung cancer. Optionally and more preferably, the fragment of trophinin associated protein (tastin) comprises segment_TAA-14, 35 and 42—SEQ ID no. 1503, 1504, 1506.

Also optionally and more preferably, any suitable method may be used for detecting a fragment such as trophinin associated protein (tastin)_segment_TAA-14, 35 and 42—SEQ ID NOs 1503, 1504 and 1506 for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, trophinin associated protein (tastin) splice variants containing the unique segments as depicted in SEQ ID Nos 1502 and 1505, for example as these included in variants 9 and 29 (SEQ ID NOs: 1482 and 1490, respectively), are useful as biomarkers for detecting lung cancer.

The present invention also optionally and preferably encompasses any nucleic acid sequence or fragment thereof, or amino acid sequence or fragment thereof, corresponding to trophinin associated protein (tastin) as described above, optionally for any application.

Expression of Homeo Box C10 (HOXC10) [N31842] Transcripts which are Detectable by Amplicon as Depicted in SEQ ID NO:1517 in Normal and Cancerous Lung Tissues Expression of Homeo box C10 (HOXC10) transcripts detectable by SEQ ID NO:1517 (e.g., variant no. 3, represented by SEQ ID 1519) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:3), Ubiquitin (GenBank Accession No. BC000449 (SEQ ID NO:1711); amplicon—SEQ ID NO:9) and SDHA (GenBank Accession No. NM_004168 (SEQ ID NO:1712); amplicon—SEQ ID NO:1477), was measured similarly. For each RT sample, the expression of SEQ ID NO:1517 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 55:
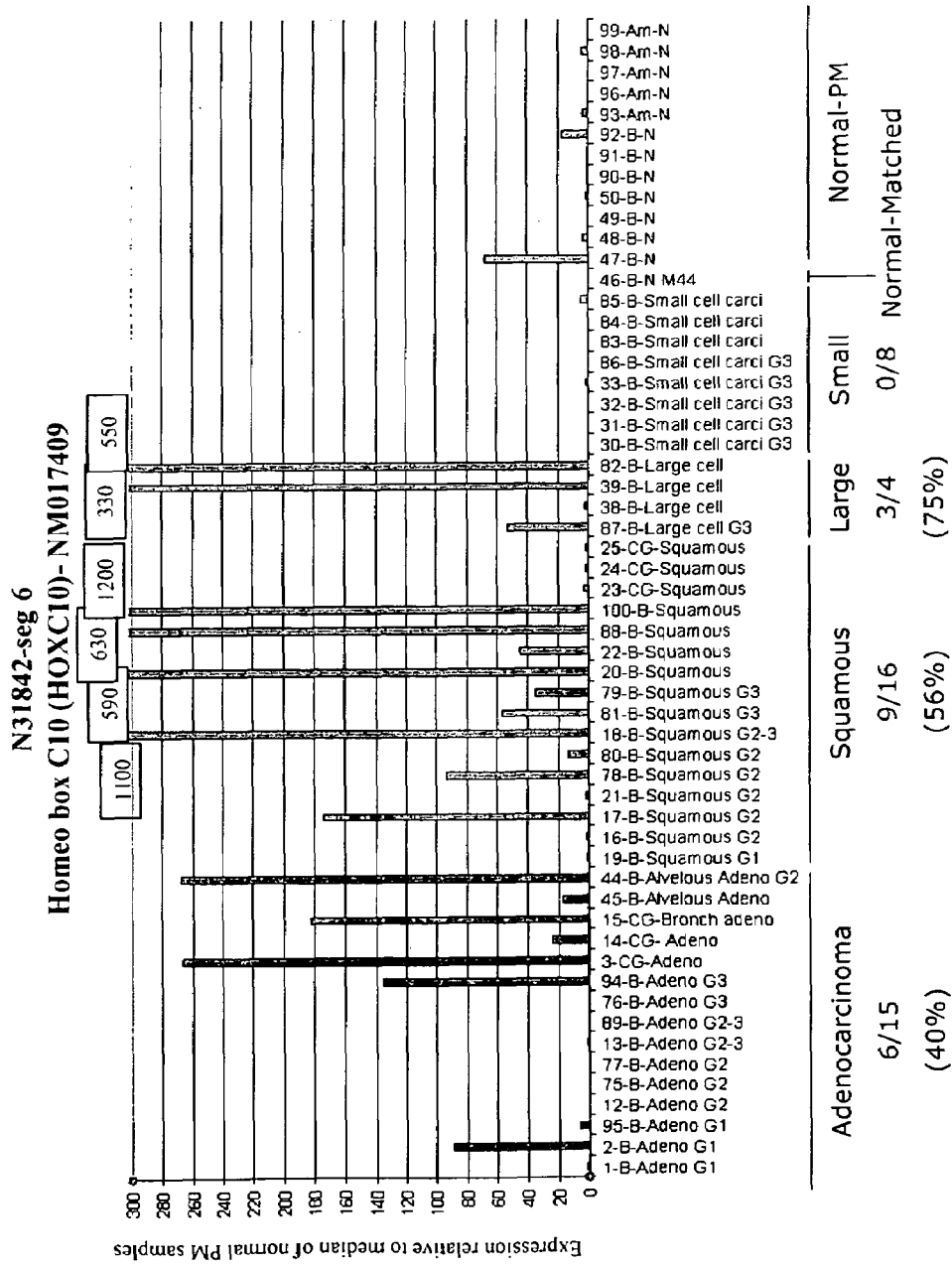
FIG. 55 is a histogram showing the relative expression of Homeo box C10 (HOXC10) [N31842] variants (e.g., variant no. 3) in normal and tumor derived lung samples as determined by real time PCR using primers for SEQ ID NO: 1517.

FIG. 55 is a histogram showing over expression of the above-indicated Homeo box C10 (HOXC10) transcripts in cancerous lung samples relative to the normal samples. The number and percentage of samples that exhibit at least 20 fold over-expression, out of the total number of samples tested is indicated in the bottom.

As is evident from FIG. 55, the expression of Homeo box C10 (HOXC10) transcripts detectable by SEQ ID NO:1517 in cancer samples was significantly higher than in the non-cancerous samples (Sample Nos. 46-50, 90-93, 96-99, Table 2, "Tissue samples in testing panel"). Notably an over-expression of at least 20 fold was found in 6 out of 15 adenocarcinoma samples, 9 out of 16 squamous cell carcinoma samples, and in 3 out of 4 large cell carcinoma samples.

Statistical analysis was applied to verify the significance of these results, as described below.

The P value for the difference in the expression levels of Homeo box C10 (HOXC10) transcripts detectable by SEQ ID NO: 1517 in lung cancer samples versus the normal lung samples was determined by T test as 4.43E-03.

Threshold of 20 fold overexpression was found to differentiate between cancer and normal samples with P value of 2.88E-02 as checked by exact fisher test. The above values demonstrate statistical significance of the results.

According to the present invention, Homeo box C10 (HOXC10) is a non-limiting example of a marker for diagnosing lung cancer. The Homeo box C10 (HOXC10) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Homeo box C10 (HOXC10) as previously defined is also encompassed within the present invention. Primer pairs are also optionally and preferably encompassed within the present invention; for example, for the above experiment, the following primer pair was used as a non-limiting illustrative example only of a suitable primer pair: Homeo box C10 (HOXC10)-forward primer (SEQ ID NO: 1515): GCGAAACGCGATTTGTTGTT; and Homeo box C10 (HOXC10)-Reverse primer (SEQ ID NO:1516): CATCTGGAGGAGGGAGGGA.

The present invention also preferably encompasses any amplicon obtained through the use of any suitable primer pair; for example, for the above experiment, the following amplicon was obtained as a non-limiting illustrative example only of a suitable amplicon: Homeo box C10 (HOXC10) amplicon (SEQ ID NO:1517):

```
GCGAAACGCGATTTGTTGTTTGTGGGTCTGATTTGTGCGTGCGGCTTGGGCTCCTGC
GGCTTTTGGCTCGGCCGGGGCCTTGGGCAGCGAGGCTGGAGCCGGAAGAGGTGG
AGGTGAAGGGCTGCCCGCCACGTCCCTCCCTCCTCCAGATG.
```

According to other preferred embodiments of the present invention, Homeo box C10 (HOXC10) or a fragment thereof comprises a biomarker for detecting lung cancer. Optionally and more preferably, Homeo box C10 (HOXC10) splice variants, as depicted in SEQ ID NO:54 (e.g., variant no. 3), or a fragment thereof comprise a biomarker for detecting lung cancer. Optionally and more preferably, the fragment of Homeo box C10 (HOXC10) comprises segment_TAA-seg 6 (SEQ ID NO: 1526). Also optionally and more preferably, any suitable method may be used for detecting a fragment such as Homeo box C10 (HOXC10)_segment_TAA-seg 6 (SEQ ID NO:1526) for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, Homeo box C10 (HOXC10) splice variants containing the unique segments as depicted in SEQ ID NOs: 1524 and 1525, for example transcripts as depicted in SEQ ID NO: 1515, 1519 and 1520, comprise a biomarker for detecting lung cancer.

According to still other preferred embodiments, the present invention optionally and preferably encompasses any amino acid sequence or fragment thereof encoded by a nucleic acid sequence corresponding to trophinin associated protein (tastin) as described above, including but not limited to SEQ ID NOs: 1521 and 1522. Any oligopeptide or peptide relating to such an amino acid sequence or fragment thereof may optionally also (additionally or alternatively) be used as a biomarker, including but not limited to the unique amino acid sequence of the protein SEQ ID NO: 1522, as depicted in SEQ ID NO: 1523. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to trophinin associated protein (tastin) as described above, optionally for any application.

Expression of Nucleolar Protein 4 (NOL4)-[T06014] Transcripts which are Detectable by Amplicon as Depicted in SEQ IDs NO: 1529 in Normal and Cancerous Lung Tissues Expression of Nucleolar protein 4 (NOL4) transcripts detectable by SEQ ID NOs:1529 (e.g., variant no. 3, 11 and 12, represented by SEQ IDs 1533, 1537, 1538) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1529 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above, "Tissue samples in testing panel"), to obtain a value of fold up-regulation for each sample relative to median of the normal PM samples.

Figure 56A:
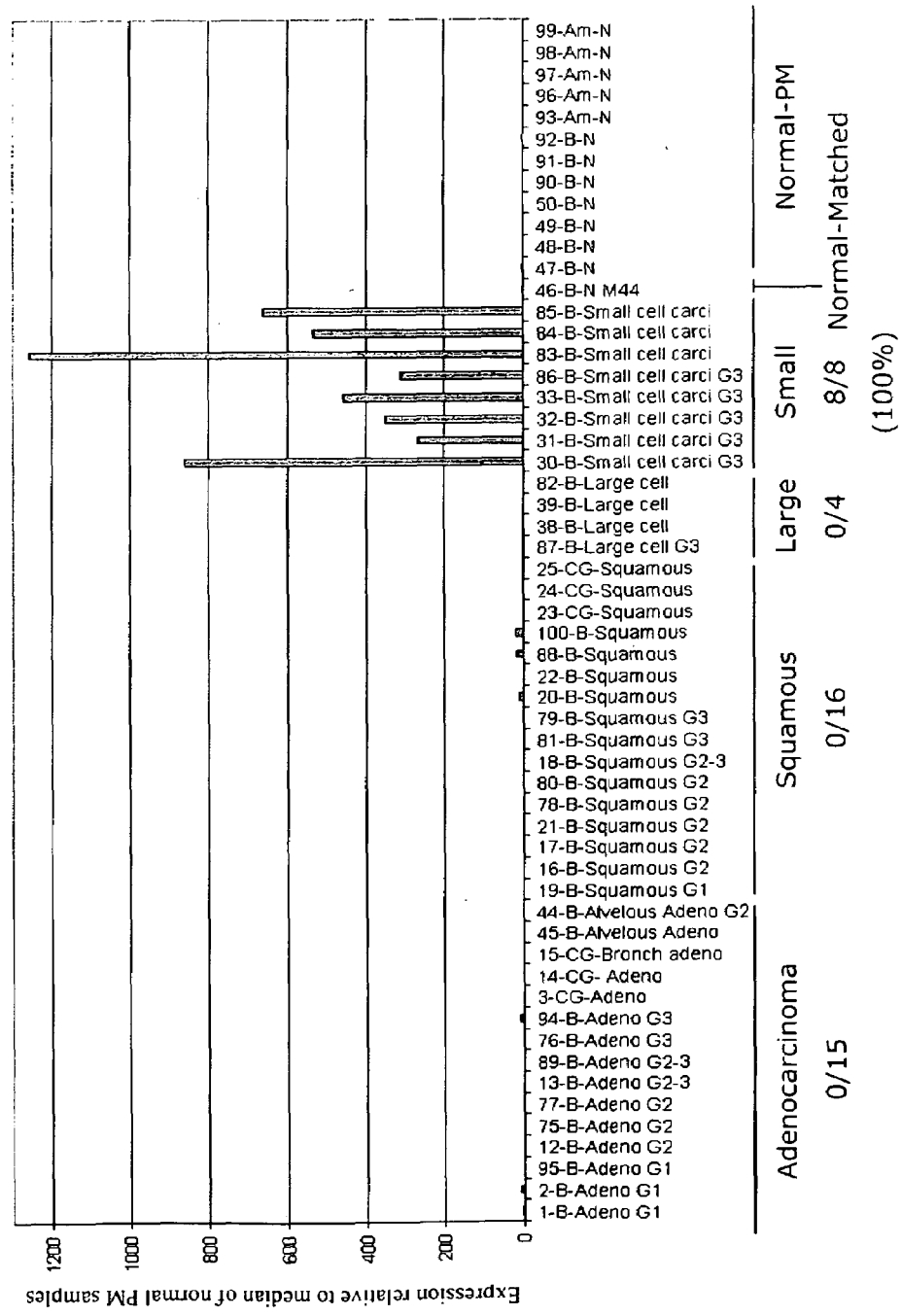
FIGS. 56a-b are histograms showing on two different scales the relative expression of Nucleolar protein 4 (NOL4) [T06014] variants (e.g., variant no. 3, 11 and 12) in normal and tumor derived lung samples as determined by real time PCR using primers for SEQ ID NO: 1529.
Figure 56B:
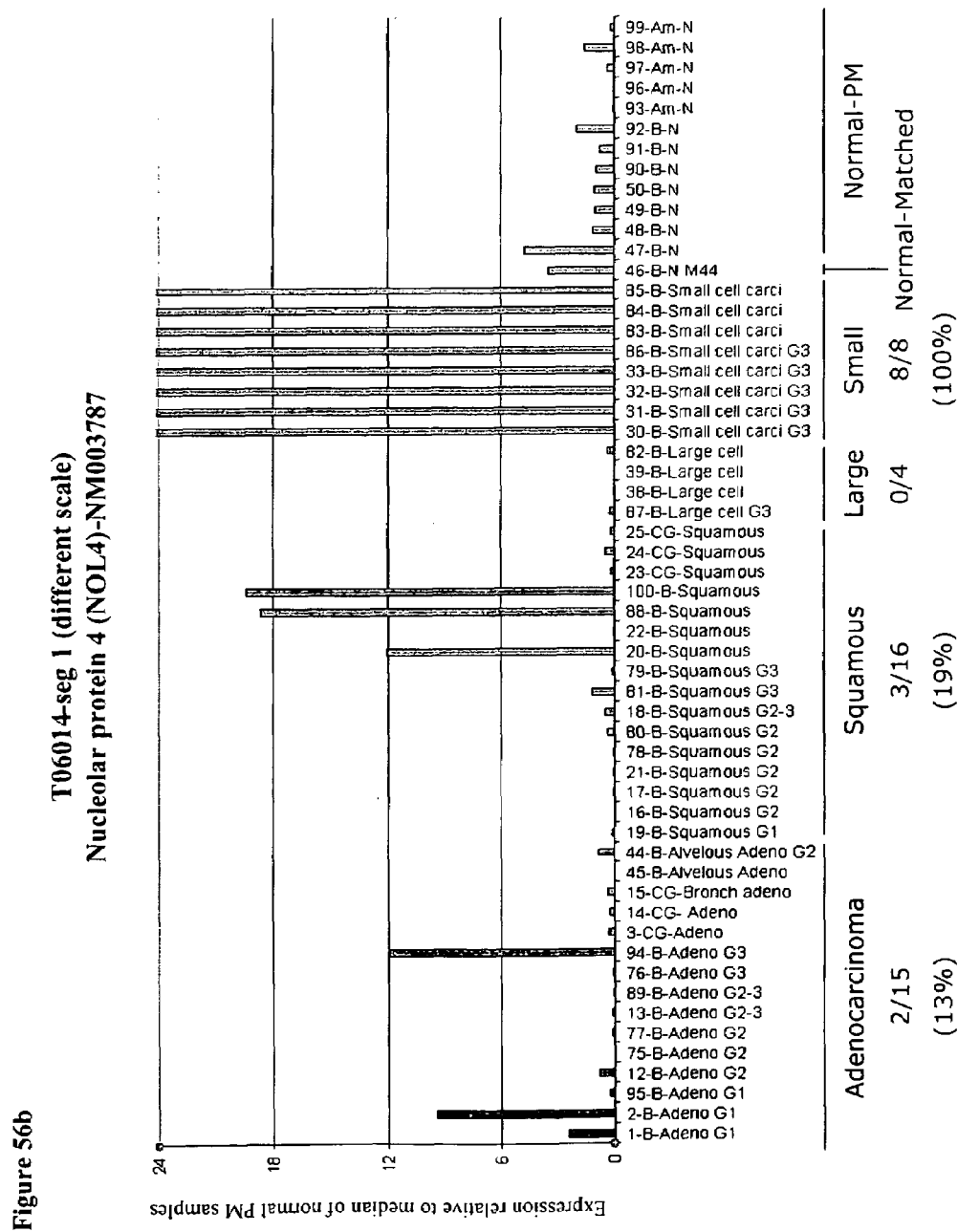

FIGS. 56a and b are histograms showing over expression of the above-indicated Nucleolar protein 4 (NOL4) transcripts in cancerous lung samples relative to the normal samples. The number and percentage of samples that exhibit at least 200 fold or 6 fold over-expression, out of the total number of samples tested is indicated in the bottom of FIGS. 56a and 56b respectively.

As is evident from FIG. 56a, the expression of Nucleolar protein 4 (NOL4) transcripts detectable by SEQ ID NO: 1529 in the samples originate from small cell carcinoma of the lung was significantly higher than in the non-cancerous samples (Sample Nos. 46-50, 90-93, 96-99, Table 2, "Tissue samples in testing panel"). Notably an over-expression of at least 200 fold was found in 8 out of 8 small cell carcinoma samples. As is evident from FIG. 56b, over expression of at least 6 fold was observed also in 2 out of 15 adenocarcinoma samples, 3 out of 16 squamous cell carcinoma samples.

Statistical analysis was applied to verify the significance of these results, as described below.

The P value for the difference in the expression levels of Nucleolar protein 4 (NOL4) transcripts detectable by SEQ ID NO:1529 in lung cancer samples versus the normal lung samples was determined by T test as 1.36E-02.

Threshold of 6 fold overexpression was found to differentiate between cancer and normal samples with P value of 2.52E-02 as checked by exact fisher test.

The P value for the difference in the expression levels of Nucleolar protein 4 (NOL4) transcripts detectable by SEQ ID NO:1529 in lung small cell carcinoma samples versus the normal lung samples was determined by T test as 3.86E-03.

Threshold of 200 fold overexpression was found to differentiate between small cell carcinoma and normal lung samples with P value of 7.94E-06 as checked by exact fisher test.

The above values demonstrate statistical significance of the results.

According to the present invention, Nucleolar protein 4 (NOL4) is a non-limiting example of a marker for diagnosing lung cancer. The Nucleolar protein 4 (NOL4) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Nucleolar protein 4 (NOL4) as previously defined is also encompassed within the present invention. Primer pairs are also optionally and preferably encompassed within the present invention; for example, for the above experiment, the following primer pair was used as a non-limiting illustrative example only of a suitable primer pair: Nucleolar protein 4 (NOL4)-TAA-seg1-forward primer (SEQ ID NO:1527): CTCGCTCCCTTGCTCACAC; and Nucleolar protein 4 (NOL4)-TAA-seg1-Reverse primer (SEQ ID NO:1528): AAAGGGAAAGCGGGATGTTT.

The present invention also preferably encompasses any amplicon obtained through the use of any suitable primer pair; for example, for the above experiment, the following amplicon was obtained as a non-limiting illustrative example only of a suitable amplicon: Nucleolar protein 4 (NOL4) amplicon (SEQ ID NO:1529):

```
CTCGCTCCCTTGCTCACACACACGCACACACTCAGCCTGGCCGAGCAGGAGCCACT
GACCATTTTGCAAGTGTCAGGACCAGCTACAGCGCGGTGGGCGCAAACATCCCGCT
TTCCCTTT.
```

According to other preferred embodiments of the present invention, Nucleolar protein 4 (NOL4) or a fragment thereof comprises a biomarker for detecting lung cancer. Optionally and more preferably, Nucleolar protein 4 (NOL4) splice variants, as depicted in SEQ ID NO:1529 (e.g., variants nos. 3, 11 and 12), or a fragment thereof comprise a biomarker for detecting lung cancer. Optionally and more preferably, the fragment of Nucleolar protein 4 (NOL4) comprises segment_TAA-seg-1 (SEQ ID NO:1552). Also optionally and more preferably, any suitable method may be used for detecting a fragment such as Nucleolar protein 4 (NOL4)_segment-_TAA-seg-1 (SEQ ID NO:1552) for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, Nucleolar protein 4 (NOL4) splice variants containing the unique segments as depicted in SEQ ID NOs: 1554 and 1555, for example transcripts as depicted in SEQ ID NOs: 1534-1536 and 1539-1541, comprises a biomarker for detecting lung cancer.

According to still other preferred embodiments, the present invention optionally and preferably encompasses any amino acid sequence or fragment thereof encoded by a nucleic acid sequence corresponding to Nucleolar protein 4 (NOL4) as described above, including but not limited to SEQ ID Nos: 1542, 1547 and 1543; 1548, 1545, 1546, and 1549-1551. Any oligopeptide or peptide relating to such an amino acid sequence or fragment thereof may optionally also (additionally or alternatively) be used as a biomarker, including but not limited to the unique amino acid sequence of the protein SEQ ID NO: 1543, 1546, 1549 as depicted in SEQ ID NO:1544.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to Nucleolar protein 4 (NOL4) as described above, optionally for any application.

Expression of Nucleolar Protein 4 (NOL4)-[T06014] Transcripts which are Detectable by Amplicon as Depicted in SEQ IDs NO:1532 in Normal and Cancerous Lung Tissues Expression of Nucleolar protein 4 (NOL4) transcripts detectable by SEQ ID NOs:1532 (e.g., variant no. 3, 11 and 12, represented by SEQ IDs 1533, 1537, 1538) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO: 1481), was measured similarly. For each RT sample, the expression of SEQ ID NO:1532 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 57A:
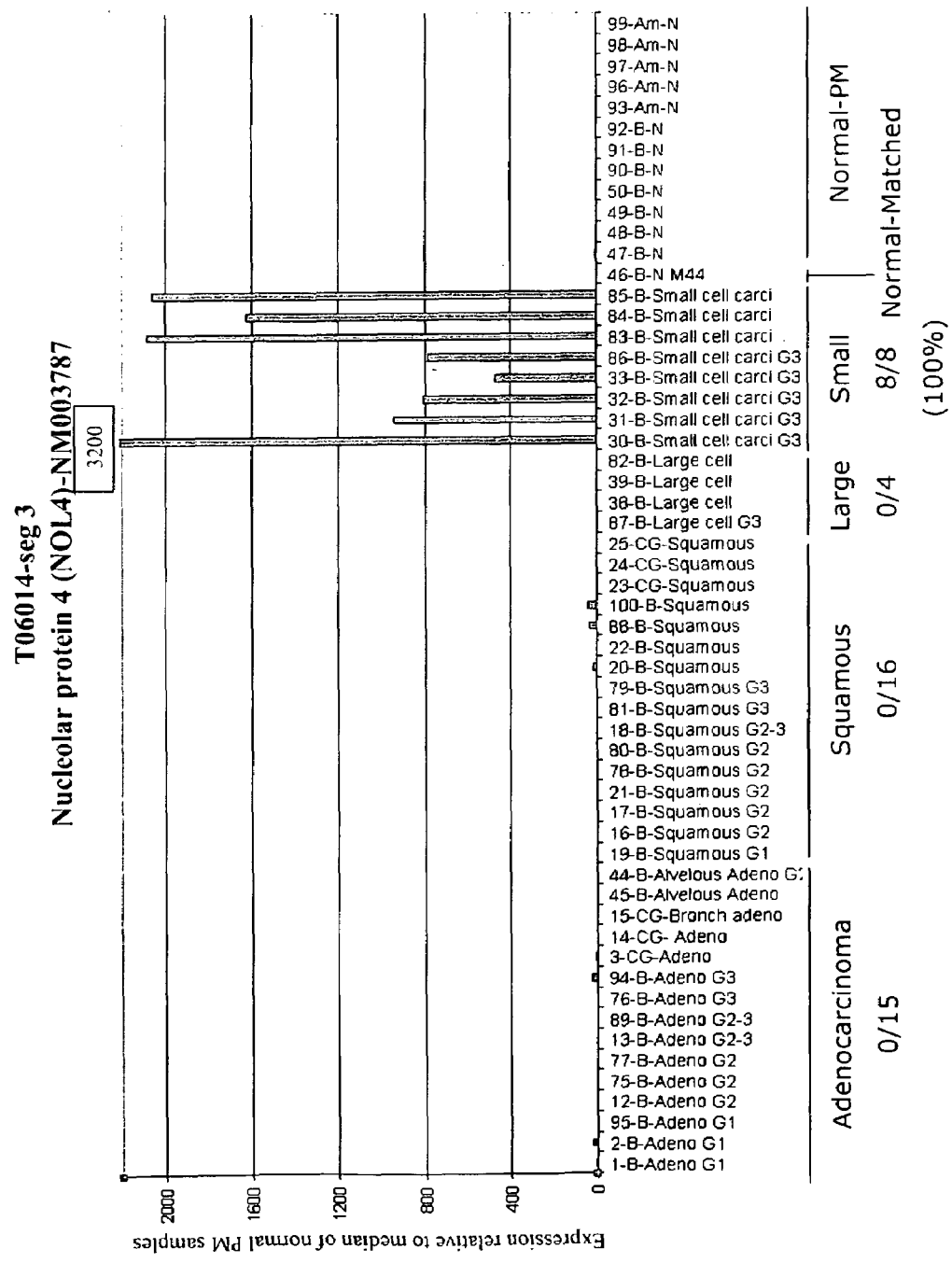
FIGS. 57a-b is a histogram showing on two different scales the relative expression of Nucleolar protein 4 (NOL4) [T06014] variants (e.g., variant no. 3, 11 and 12) in normal and tumor derived lung samples as determined by real time PCR using primers for SEQ ID NO: 1532.
Figure 57B:
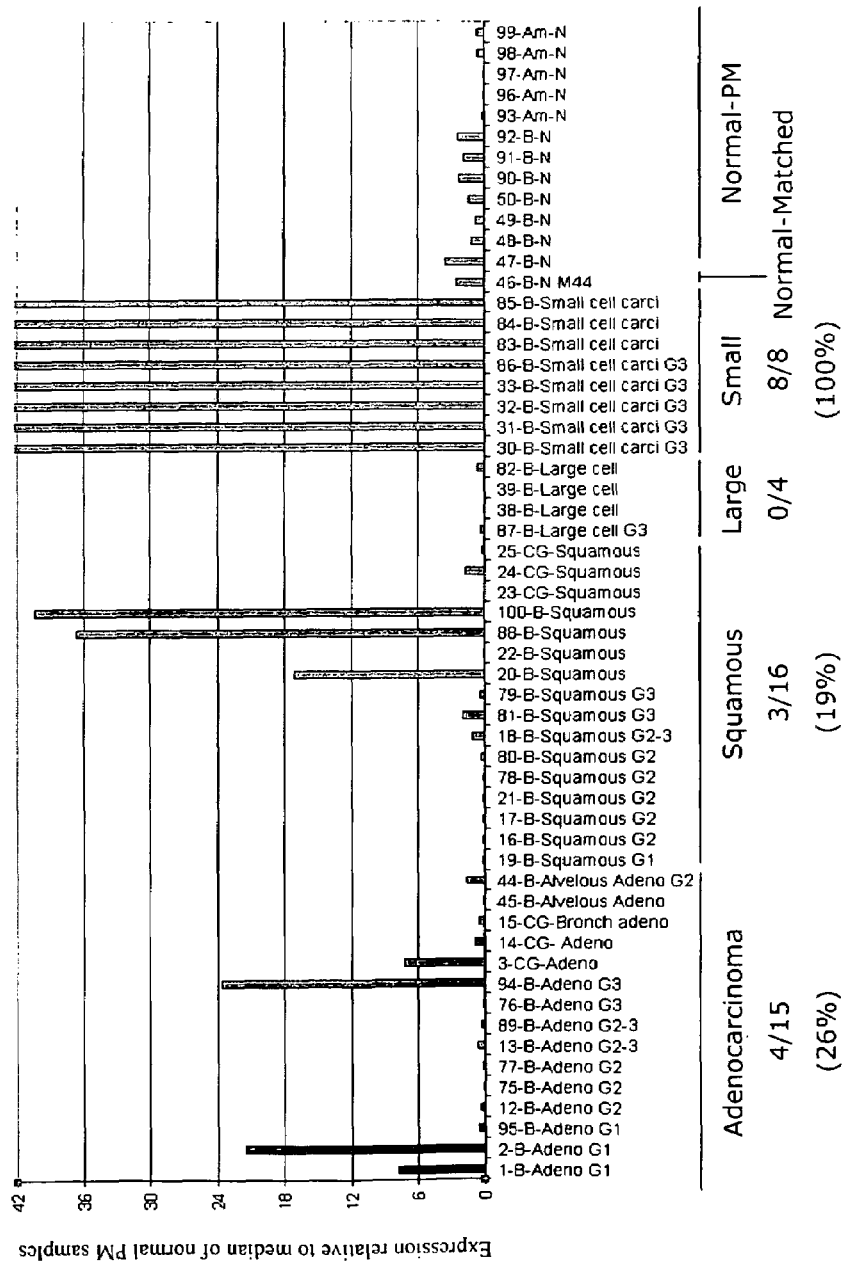

FIGS. 57a and b are histograms showing over expression of the above-indicated Nucleolar protein 4 (NOL4) transcripts in cancerous lung samples relative to the normal samples. The number and percentage of samples that exhibit at least 400 fold or 6 fold over-expression, out of the total number of samples tested is indicated in the bottom of FIGS. 57a and b respectively.

As is evident from FIG. 57a, the expression of Nucleolar protein 4 (NOL4) transcripts detectable by SEQ ID NO:1532 in the samples originate from small cell carcinoma of the lung was significantly higher than in the non-cancerous samples (Sample Nos. 46-50, 90-93, 96-99, Table 2, "Tissue samples in testing panel"). Notably an over-expression of at least 400 fold was found in 8 out of 8 small cell carcinoma samples. As is evident from FIG. 4b, over expression of at least 6 fold was observed also in 4 out of 15 adenocarcinoma samples, 3 out of 16 squamous cell carcinoma samples.

Statistical analysis was applied to verify the significance of these results, as described below.

The P value for the difference in the expression levels of Nucleolar protein 4 (NOL4) transcripts detectable by SEQ ID NO:1532 in lung cancer samples versus the normal lung samples was determined by T test as 1.70E-02.

Threshold of 6 fold overexpression was found to differentiate between cancer and normal samples with P value of 1.80E-02 as checked by exact fisher test.

The P value for the difference in the expression levels of Nucleolar protein 4 (NOL4) transcripts detectable by SEQ ID NO:1532 in lung small cell carcinoma samples versus the normal lung samples was determined by T test as 7.08E-03.

Threshold of 400 fold overexpression was found to differentiate between small cell carcinoma and normal lung samples with P value of 1.03E-04 as checked by exact fisher test. The above values demonstrate statistical significance of the results.

According to the present invention, Nucleolar protein 4 (NOL4) is a non-limiting example of a marker for diagnosing lung cancer. The Nucleolar protein 4 (NOL4) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Nucleolar protein 4 (NOL4) as previously defined is also encompassed within the present invention. Primer pairs are also optionally and preferably encompassed within the present invention; for example, for the above experiment, the following primer pair was used as a non-limiting illustrative example only of a suitable primer pair: Nucleolar protein 4 (NOL4)-TAA-seg 3-forward primer (SEQ ID NO: 1530): ACATCCCCCTGGAACGGAT; and Nucleolar protein 4 (NOL4)-TAA-seg 3-Reverse primer (SEQ ID NO:1531): CAGAAATTAGCAAAGCATTGATGG.

The present invention also preferably encompasses any amplicon obtained through the use of any suitable primer pair; for example, for the above experiment, the following amplicon was obtained as a non-limiting illustrative example only of a suitable amplicon: Nucleolar protein 4 (NOL4) amplicon (SEQ ID NO: 1532):

ACATCCCCTGGAACGGATATCTGTTTGGGGCACTACAATCTATCCTGTAGAACTAT
GGCCAAATCTCCATCAATGCTTTGCTAATTTCTG.

According to other preferred embodiments of the present invention, Nucleolar protein 4 (NOL4) or a fragment thereof comprises a biomarker for detecting lung cancer. Optionally and more preferably, Nucleolar protein 4 (NOL4) splice variants, as depicted in SEQ ID NO:1533, 1537, 1538 (e.g., variants nos. 3, 11, 12), or a fragment thereof comprise a biomarker for detecting lung cancer. Optionally and more preferably, the fragment of Nucleolar protein 4 (NOL4) comprises segment_TAA-seg-3 (SEQ ID NO:1553). Also optionally and more preferably, any suitable method may be used for detecting a fragment such as Nucleolar protein 4 (NOL4)_segment_TAA-seg-3 (SEQ ID NO:1553) for example. Most preferably, NAT-based technology used, such as any nucleic acid molecule capable of specifically hybridizing with the fragment. Optionally and most preferably, a primer pair is used for obtaining the fragment.

According to still other preferred embodiments, the present invention optionally and preferably encompasses any amino acid sequence or fragment thereof encoded by a nucleic acid sequence corresponding to Nucleolar protein 4 (NOL4) as described above, including but not limited to SEQ ID NOs: SEQ ID Nos: 1542, 1547 and 1548. Any oligopeptide or peptide relating to such an amino acid sequence or fragment thereof may optionally also (additionally or alternatively) be used as a biomarker.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to Nucleolar protein 4 (NOL4) as described above, optionally for any application.

Expression of AA281370 Transcripts which are Detectable by Amplicon as Depicted in SEQ ID NO:1558 in Normal and Cancerous Lung Tissues AA281370 gene was identified by a computational process described above as over expressed in lung cancer. The AA281370 encoded proteins (SEQ ID NO: 1563, 1564) contain several WD40 domains, which are found in a number of eukaryotic proteins that cover a wide variety of functions, including adaptor/regulatory modules in signal transduction, pre-mRNA processing and cytoskeleton assembly. As is demonstrated in FIG. 63, the WD40 domain region of AA281370 encoded protein, depicted in SEQ ID NO: 1564, has several similarities that might suggest involvement in signal transduction MAPK pathway. For example, the region of the AA281370 polypeptide SEQ ID NO: 1564 located between amino acids at positions 40-790 has 75% homology to the WD40 domain region of mouse Mapkbp1 protein (gi|47124622) (FIG. 63*a*); and the amino acids at positions 40-886 of the AA281370 polypeptide SEQ ID NO:1564 has 70% homology to rat JNK-binding protein JNKBP1 (gi|34856717) (FIG. 63*b*).

Expression of AA281370 transcripts detectable by SEQ ID NO: 1558 (e.g., variant no. 0, 1, 4 and 5, represented in SEQ IDs 1559-1562) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1558 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 58:
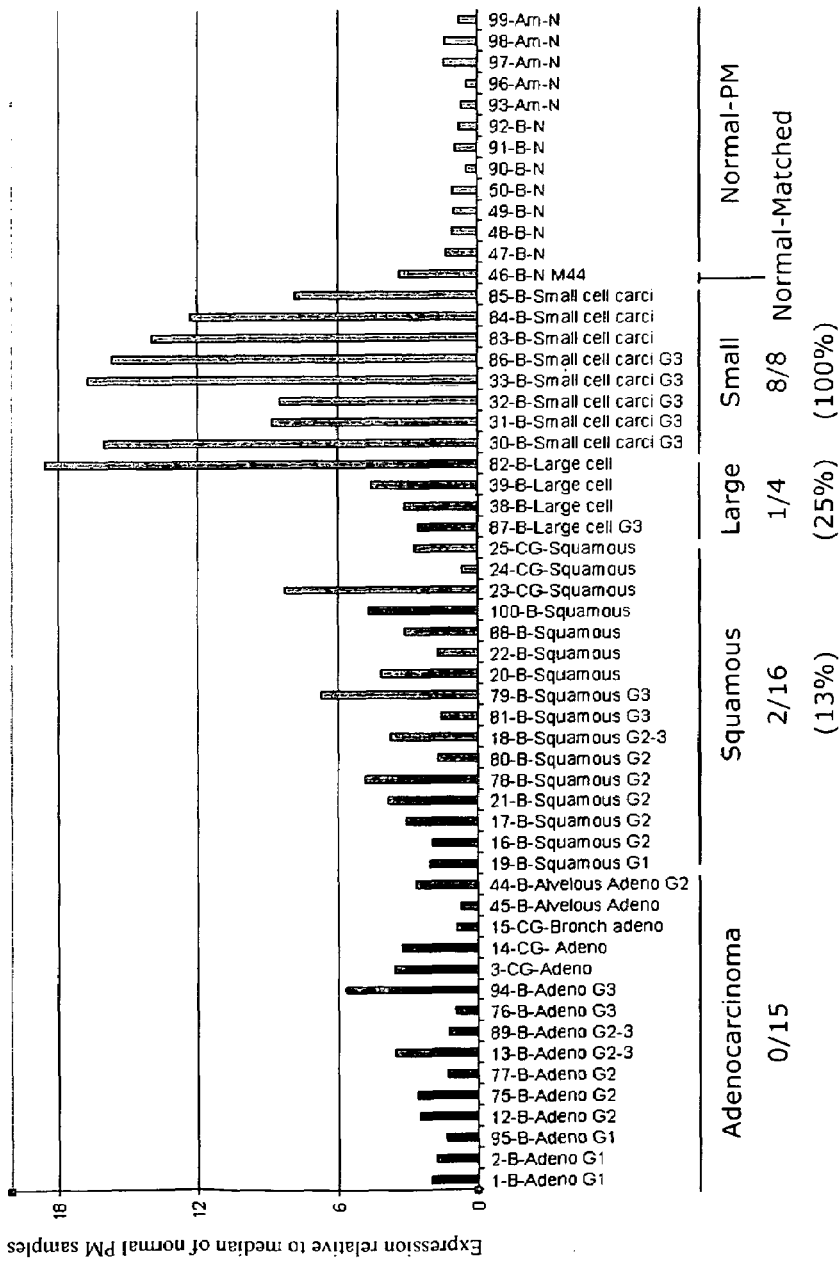
FIG. 58 is a histogram showing the relative expression of AA281370 variants (e.g., variant no. 0, 1, 4 and 5) in normal and tumor derived lung samples as determined by real time PCR using primers for SEQ ID NO:1558.

FIG. 58 is a histogram showing over expression of the above-indicated AA281370 transcripts in cancerous lung samples relative to the normal samples. The number and percentage of samples that exhibit at least 6 fold over-expression, out of the total number of samples tested is indicated in the bottom.

As is evident from FIG. 58, the expression of AA281370 transcripts detectable by SEQ ID NO:1558 in cancer samples was significantly higher than in the non-cancerous samples (Sample Nos. 46-50, 90-93, 96-99, Table 2, "Tissue samples in testing panel"). Notably an over-expression of at least 6 fold was found in 8 out of 8 small cell carcinoma, 2 out of 16 squamous cell carcinoma samples, and in 1 out of 4 large cell carcinoma samples.

Statistical analysis was applied to verify the significance of these results, as described below.

The P value for the difference in the expression levels of AA281370 transcripts detectable by SEQ ID NO:1558 in lung cancer samples versus the normal lung samples was determined by T test as 8.58E-07.

Threshold of 6 fold overexpression was found to differentiate between cancer and normal samples with P value of 4.81E-02 as checked by exact fisher test.

The above values demonstrate statistical significance of the results.

According to the present invention, AA281370 transcripts are a non-limiting example of a marker for diagnosing lung cancer. The AA281370 marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to AA281370 as previously defined is also encompassed within the present invention. Primer pairs are also optionally and preferably encompassed within the present invention; for example, for the above experiment, the following primer pair was used as a non-limiting illustrative example only of a suitable primer pair: AA281370-forward primer (SEQ ID NO: 1556): GGTTCG-GATGGACTACACTTTGTC; and AA281370-Reverse primer (SEQ ID NO: 1557): CCACGTACTTCTGGGTGAT-GTC.

The present invention also preferably encompasses any amplicon obtained through the use of any suitable primer pair; for example, for the above experiment, the following amplicon was obtained as a non-limiting illustrative example only of a suitable amplicon: AA281370-amplicon (SEQ ID NO:1558):

```
GGTTCGGATGGACTACACTTTGTCCGTACCCACCACGTAGCAGAGAAAACCACCTT
GTATGACATGGACATTGACATCACCCAGAAGTACGTGG.
```

According to other preferred embodiments of the present invention, AA281370 or a fragment thereof comprises a biomarker for detecting lung cancer. Optionally and more preferably, AA281370 splice variants, as depicted in SEQ ID NO:1558 (e.g., variants no: 0, 1, 4 and 5), or a fragment thereof comprise a biomarker for detecting lung cancer. Optionally and more preferably, the fragment of AA281370 comprises segment_TAA seg 10 SEQ ID NO: 1567, Also optionally and more preferably, any suitable method may be used for detecting a fragment such as AA281370_segment_TAA seg 10 SEQ ID NO: 1567 for example. Most preferably, NAT-based technology used, such as any nucleic acid molecule capable of specifically hybridizing with the fragment. Optionally and most preferably, a primer pair is used for obtaining the fragment.

According to other preferred embodiments, the present invention also optionally and preferably encompasses AA281370 splice variants containing the unique segments as depicted in SEQ ID NO: 1568, for example transcripts 4 and 5, as depicted in SEQ ID NOs: 1561 and 1562, comprises a biomarker for detecting lung cancer.

According to still other preferred embodiments, the present invention optionally and preferably encompasses any amino acid sequence or fragment thereof encoded by a nucleic acid sequence corresponding to AA281370 as described above, including but not limited to SEQ ID NOs: 1563-1566. Any oligopeptide or peptide relating to such an amino acid sequence or fragment thereof may optionally also (additionally or alternatively) be used as a biomarker, including but not limited to the unique amino acid sequence of the proteins SEQ ID NOs: 1563-1566, as depicted in SEQ ID NOs: 1569, 1570 and 1571.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to AA281370 as described above, optionally for any application.

Expression of Sulfatase 1-(SULF1)-[Z21368], Transcripts which are Detectable by Amplicon as Depicted in SEQ ID NO:1574 in Normal and Cancerous Lung Tissues SULF1 is a secreted protein which is found in the extracellular matrix. It is known to be downregulated in many epithelial cancer types.

Expression of Sulfatase 1 (SULF1) transcripts detectable by SEQ ID NO:1574 (e.g., variant no. 13 and 14, represented in SEQ ID 1578, 1579) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1574 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 59:
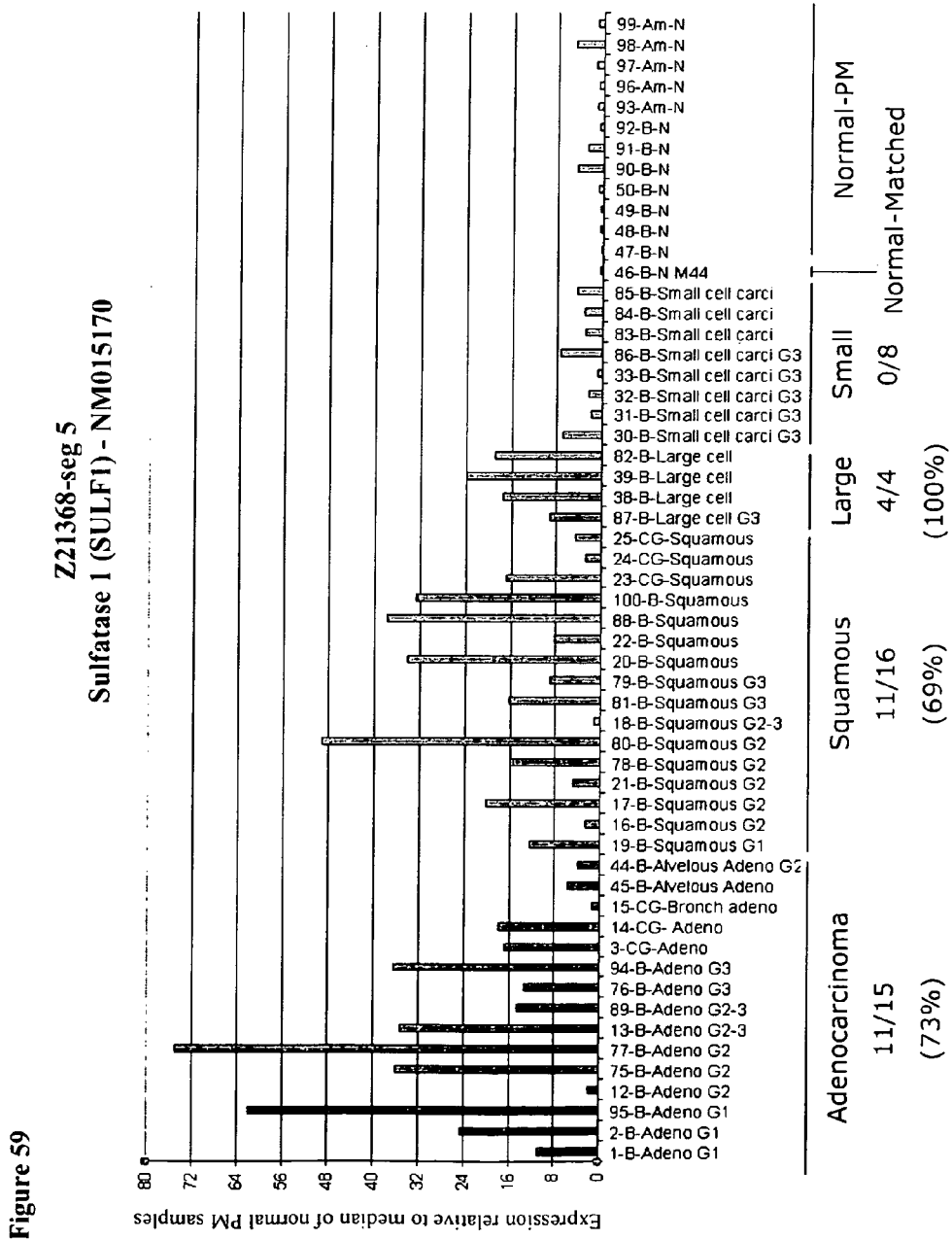
FIG. 59 is a histogram showing the relative expression of Sulfatase 1 (SULF1)-[Z21368] variants (e.g., variant no. 13 and 14) in normal and tumor derived lung samples as determined by real time PCR using primers for SEQ ID NO:1574.

FIG. 59 is a histogram showing over expression of the above-indicated Sulfatase 1 (SULF1) transcripts in cancerous lung samples relative to the normal samples. The number and percentage of samples that exhibit at least 8 fold over-expression, out of the total number of samples tested is indicated in the bottom.

As is evident from FIG. 59, the expression of Sulfatase 1 (SULF1) transcripts detectable by SEQ ID NO:1574 in cancer samples originate from non-cell carcinoma was significantly higher than in the non-cancerous samples (Sample Nos. 46-50, 90-93, 96-99, Table 2, "Tissue samples in testing panel"). Notably an over-expression of at least 8 fold was found in 11 out of 15 adenocarcinoma samples, 11 out of 16 squamous cell carcinoma samples, and in 4 out of 4 large cell carcinoma samples.

Statistical analysis was applied to verify the significance of these results, as described below.

The P value for the difference in the expression levels of Sulfatase 1 (SULF1) transcripts detectable by SEQ ID NO:1574 in lung cancer samples versus the normal lung samples was determined by T test as 3.18E-07.

Threshold of 8 fold overexpression was found to differentiate between cancer and normal samples with P value of 1.18E-04 as checked by exact fisher test.

The above values demonstrate statistical significance of the results.

According to the present invention, Sulfatase 1 (SULF1) is a non-limiting example of a marker for diagnosing lung cancer. The Sulfatase 1 (SULF1) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Sulfatase 1 (SULF1) as previously defined is also encompassed within the present invention. Primer pairs are also optionally and preferably encompassed within the present invention; for example, for the above experiment, the following primer pair was used as a non-limiting illustrative example only of a suitable primer pair: Sulfatase 1 (SULF1)-forward primer (SEQ ID NO:1572): ACTCACTCAGAGACTAACACAAAGGAAG; and Sulfatase 1 (SULF1)-Reverse primer (SEQ ID NO:1573): AGTATGGGAAGAATTTACTGGTCACA.

The present invention also preferably encompasses any amplicon obtained through the use of any suitable primer pair; for example, for the above experiment, the following amplicon was obtained as a non-limiting illustrative example only of a suitable amplicon: Sulfatase 1 (SULF1)-amplicon (SEQ ID NO: 1574):

```
ACTCACTCAGAGACTAACACAAAGGAAGTAATTTCTTACCTGGTCATTATTTAGTCT
ACAATAAGTTCATCCTTCTTCAGTGTGACCAGTAAATTCTTCCCATACT.
```

According to other preferred embodiments of the present invention, Sulfatase 1 (SULF1) or a fragment thereof comprises a biomarker for detecting lung cancer. Optionally and more preferably, Sulfatase 1 (SULF1) splice variants, as depicted in SEQ ID NO:1578, 1579 (e.g., variants no: 13 and 14), or a fragment thereof comprise a biomarker for detecting lung cancer. Optionally and more preferably, the fragment of Sulfatase 1 (SULF1) comprises segment_TAA seg 5—SEQ ID NO:1587. Also optionally and more preferably, any suitable method may be used for detecting a fragment such as Sulfatase 1 (SULF1)_segment_TAA seg 5—SEQ ID NO:1587 for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, Sulfatase 1 (SULF1) splice variants containing the unique segments as depicted in SEQ ID NOs: 1588-1591, for example transcripts as depicted in SEQ ID NOs: 1575-1577, comprises a biomarker for detecting lung cancer.

According to still other preferred embodiments, the present invention optionally and preferably encompasses any amino acid sequence or fragment thereof encoded by a nucleic acid sequence corresponding to Sulfatase 1 (SULF1) as described above, including but not limited to SEQ ID NOs:1586, 1580, 1582, 1584. Any oligopeptide or peptide relating to such an amino acid sequence or fragment thereof may optionally also (additionally or alternatively) be used as a biomarker, including but not limited to the unique amino acid sequence of the protein SEQ ID NO: 1580, 1582, 1584, as depicted in SEQ ID NO: 1581, 1583, 1585, respectively.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to Nucleolar protein 4 (NOL4) as described above, optionally for any application.

Expression of SRY (Sex Determining Region Y)-Box 2 (SOX2))-[HUMHMGBOX], Transcripts which are Detectable by the Amplicon as Depicted in SEQ ID NO:1594 in Normal and Cancerous Lung Tissues Expression of SOX2 transcripts detectable by SEQ ID NO:1594 (e.g., variant no. 0 represented by SEQ ID 1595) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO: 1594 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 60:
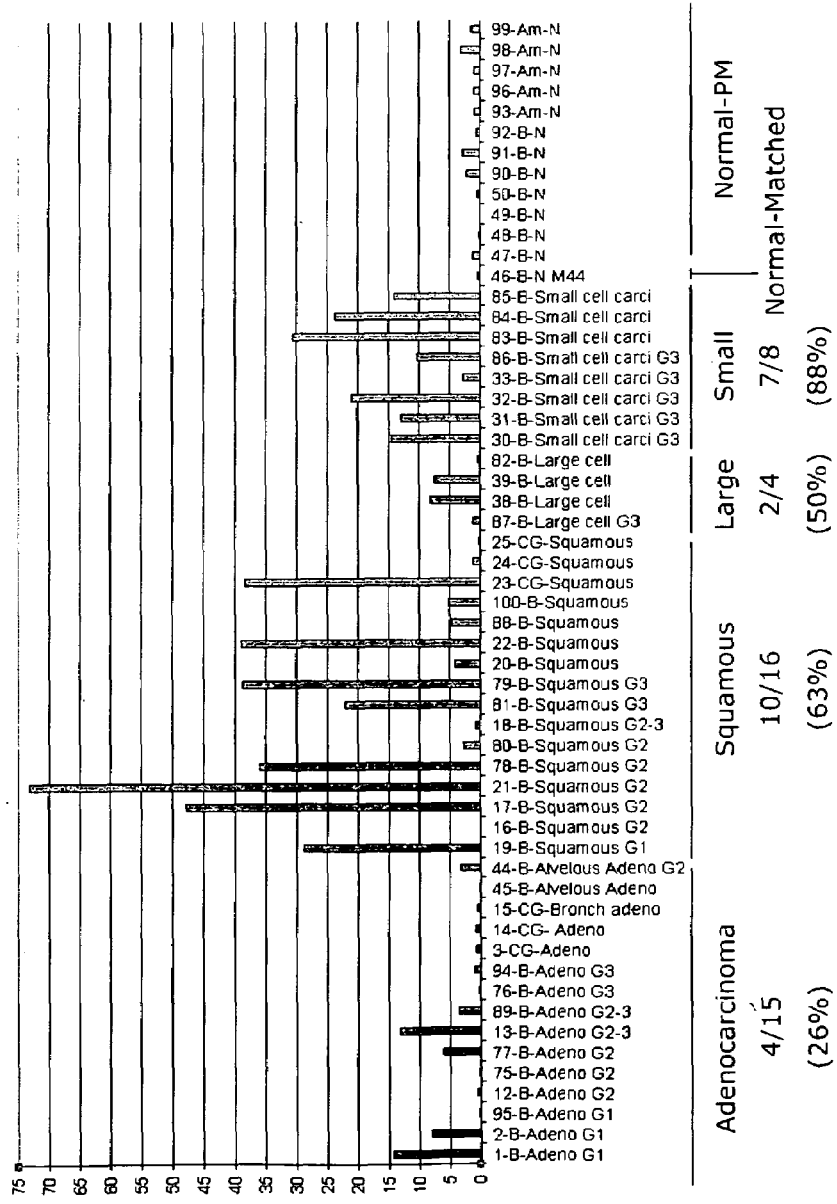
FIG. 60 is a histogram showing the relative expression of SRY (sex determining region Y)-box 2 (SOX2))-[HUMHMGBOX] variants (e.g., variant no. 0) in normal and tumor derived lung samples as determined by real time PCR using primers for SEQ ID NO:1594.

FIG. 60 is a histogram showing over expression of the above-indicated SOX2 transcripts in cancerous lung samples relative to the normal samples. The number and percentage of samples that exhibit at least 5 fold over-expression, out of the total number of samples tested is indicated in the bottom.

As is evident from FIG. 60, the expression of SOX2 transcripts detectable by SEQ ID NO: 1594 in cancer samples originate from lung carcinoma was significantly higher than in the non-cancerous samples (Sample Nos. 46-50, 90-93, 96-99, Table 2, "Tissue samples in testing panel"). Notably an over-expression of at least 5 fold was found in 4 out of 15 adenocarcinoma samples, 10 out of 16 squamous cell carcinoma samples, in 2 out of 4 large cell carcinoma, and in 7 out of 8 small cell carcinoma samples.

Statistical analysis was applied to verify the significance of these results, as described below.

The P value for the difference in the expression levels of SOX2 transcripts detectable by SEQ ID NO: 1594 in lung cancer samples versus the normal lung samples was determined by T test as 4.38E-05.

Threshold of 5 fold overexpression was found to differentiate between cancer and normal samples with P value of 8.09E-04 as checked by exact fisher test.

The above values demonstrate statistical significance of the results.

According to the present invention, SOX2 is a non-limiting example of a marker for diagnosing lung cancer. The SOX2 marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to SOX2 as previously defined is also encompassed within the present invention. Primer pairs are also optionally and preferably encompassed within the present invention; for example, for the above experiment, the following primer pair was used as a non-limiting illustrative example only of a suitable primer pair: SOX2-forward primer (SEQ ID NO: 1592): GGCGGCGGCAGGAT; and SOX2-Reverse primer (SEQ ID NO: 1593): GTCGGGAGCG-CAGGG.

The present invention also preferably encompasses any amplicon obtained through the use of any suitable primer pair; for example, for the above experiment, the following amplicon was obtained as a non-limiting illustrative example only of a suitable amplicon: SOX2-amplicon (SEQ ID NO: 1594):

GGCGGCGGCAGGATCGGCCAGAGGAGGAGGGAAGCGCTTTTTTTGATCCTGATTCC

AGTTTGCCTCTCTCTTTTTTTCCCCCAAATTATTCTTCGCCTGATTTTCCTCGCGGAG

CCCTGCGCTCCCGAC.

According to other preferred embodiments of the present invention, SOX2 or a fragment thereof comprises a biomarker for detecting lung cancer. Optionally and more preferably, SOX2 splice variants, as depicted in SEQ ID NO:1595 (e.g., variants no: 0), or a fragment thereof comprise a biomarker for detecting lung cancer. Optionally and more preferably, the fragment of SOX2 comprises segment_TAA seg 2—SEQ ID NO:1597. Also optionally and more preferably, any suitable method may be used for detecting a fragment such as SOX2_segment_TAA seg 2—SEQ ID NO:1597 for example. Most preferably, NAT-based technology used, such as any nucleic acid molecule capable of specifically hybridizing with the fragment. Optionally and most preferably, a primer pair is used for obtaining the fragment.

According to still other preferred embodiments, the present invention optionally and preferably encompasses any amino acid sequence or fragment thereof encoded by a nucleic acid sequence corresponding to SOX2 as described above, including but not limited to SEQ ID NOs: SEQ ID NO: 1596. Any oligopeptide or peptide relating to such an amino acid sequence or fragment thereof may optionally also (additionally or alternatively) be used as a biomarker.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to SOX2 as described above, optionally for any application.

Expression of Plakophilin 1 (Ectodermal Dysplasia/Skin Fragility Syndrome) (PKP1)-[HSB6PR], Transcripts which are Detectable by the Amplicon as Depicted in SEQ ID NO:1600 in Normal and Cancerous Lung Tissues Expression of PKP1 transcripts detectable by SEQ ID NO:1600 (e.g., variant no. 0, 5 and 6-represented by SEQ IDs 1601-1603) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO: 1600 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel" above), to obtain a value of fold up-regulation for each sample relative to median of the normal PM samples.

Figure 61:
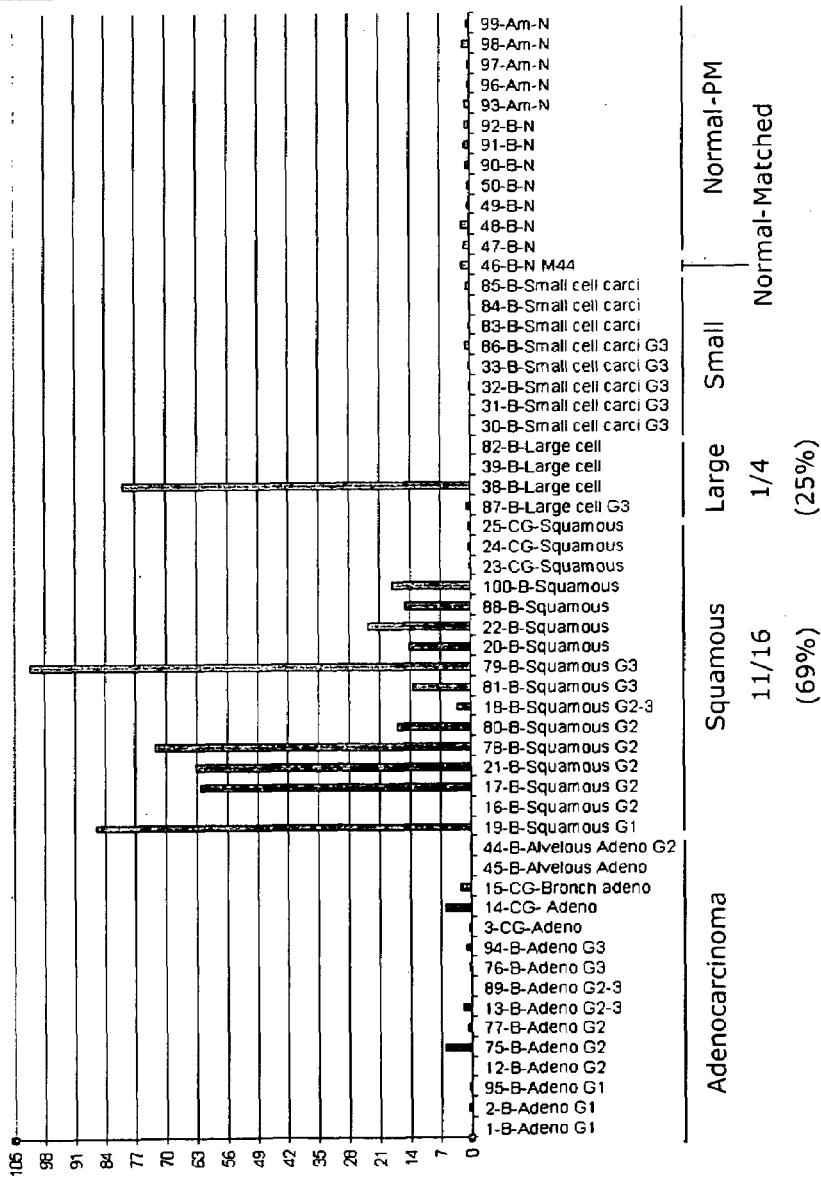
FIG. 61 is a histogram showing the relative expression of Plakophilin 1 (ectodermal dysplasia/skin fragility syndrome) (PKP1)-[HSB6PR] variants (e.g., variant no. 0, 5 and 6) in normal and tumor derived lung samples as determined by real time PCR using primers for SEQ ID NO:1600.

FIG. 61 is a histogram showing over expression of the above-indicated PKP1 transcripts in cancerous lung samples relative to the normal samples. The number and percentage of samples that exhibit at least 7 fold over-expression, out of the total number of samples tested is indicated in the bottom.

As is evident from FIG. 61, the expression of PKP1 transcripts detectable by SEQ ID NO:1600 in cancer samples originate from lung carcinoma was significantly higher than in the non-cancerous samples (Sample Nos. 46-50, 90-93, 96-99, Table 2, "Tissue samples in testing panel"). Notably an over-expression of at least 7 fold was found in 11 out of 16 squamous cell carcinoma samples, and in 1 out of 4 large cell carcinoma.

Statistical analysis was applied to verify the significance of these results, as described below.

The P value for the difference in the expression levels of PKP1 transcripts detectable by SEQ ID NO:1600 in lung cancer samples versus the normal lung samples was determined by T test as 3.18E-03.

Threshold of 7 fold overexpression was found to differentiate between cancer and normal samples with P value of 3.50E-02 as checked by exact fisher test.

The above values demonstrate statistical significance of the results.

According to the present invention, PKP1 is a non-limiting example of a marker for diagnosing lung cancer. The PKP1 marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to PKP1 as previously defined is also encompassed within the present invention. Primer pairs are also optionally and preferably encompassed within the present invention; for example, for the above experiment, the following primer pair was used as a non-limiting illustrative example only of a suitable primer pair: PKP1-forward primer (SEQ ID NO: 1598): CCCCAGACTCTGTGCACTTCA; and PKP1-Reverse primer (SEQ ID NO: 1599): TGGGCTCTGCTCTGTCTTAGTGTA The present invention also preferably encompasses any amplicon obtained through the use of any suitable primer pair; for example, for the above experiment, the following amplicon was obtained as a non-limiting illustrative example only of a suitable amplicon: PKP1—amplicon (SEQ ID NO: 1600):

CCCCAGACTCTGTGCACTTCAGACCAGCAGCAGCAGGAGGGCTCCCGAGGGCCTTA

TGAGAAAACCTGTGTGGACATCCCTTGGTGTACACTAAGACAGAGCAGAGCCCA

According to other preferred embodiments of the present invention, PKP1 or a fragment thereof comprises a biomarker for detecting lung cancer. Optionally and more preferably, PKP1 splice variants, as depicted in SEQ ID NO: 1601-1603 (e.g., variants no: 0, 5 and 6), or a fragment thereof comprise a biomarker for detecting lung cancer. Optionally and more preferably, the fragment of PKP1 comprises segment_TAA seg 34-SEQ ID NO:1608. Also optionally and more preferably, any suitable method may be used for detecting a fragment such as PKP1_segment_TAA seg 34—SEQ ID NO: 1608 for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, PKP1 splice variants containing the unique segment_8 as depicted in SEQ ID NO: 1607, for example variant 6, as depicted in SEQ ID NO: 1603, are suitable as biomarkers for detecting lung cancer.

According to still other preferred embodiments, the present invention optionally and preferably encompasses any amino acid sequence or fragment thereof encoded by a nucleic acid sequence corresponding to PKP1 as described above, including but not limited to SEQ ID NOs: 1604-1606. Any oligopeptide or peptide relating to such an amino acid sequence or fragment thereof may optionally also (additionally or alternatively) be used as a biomarker.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to PKP1 as described above, optionally for any application.

Combined Expression of 12 Sequences (SEQ ID NO: 1480, 1517, 1529, 1532, 1558, 1574, 1594, 1600, 1616, 1619, 1622, 1625) in Normal and Cancerous Lung Tissues Expression of several transcripts detectable by SEQ ID NOs: 1480, 1517, 1529, 1532, 1558, 1574, 1594, 1600, 1616, 1619, 1622, 1625 was measured by real time PCR (the expression of each SEQ ID was checked separately). In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NOs: 1480, 1517, 1529, 1532, 1558, 1574, 1594, 1600, 1616, 1619, 1622, 1625 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 62:
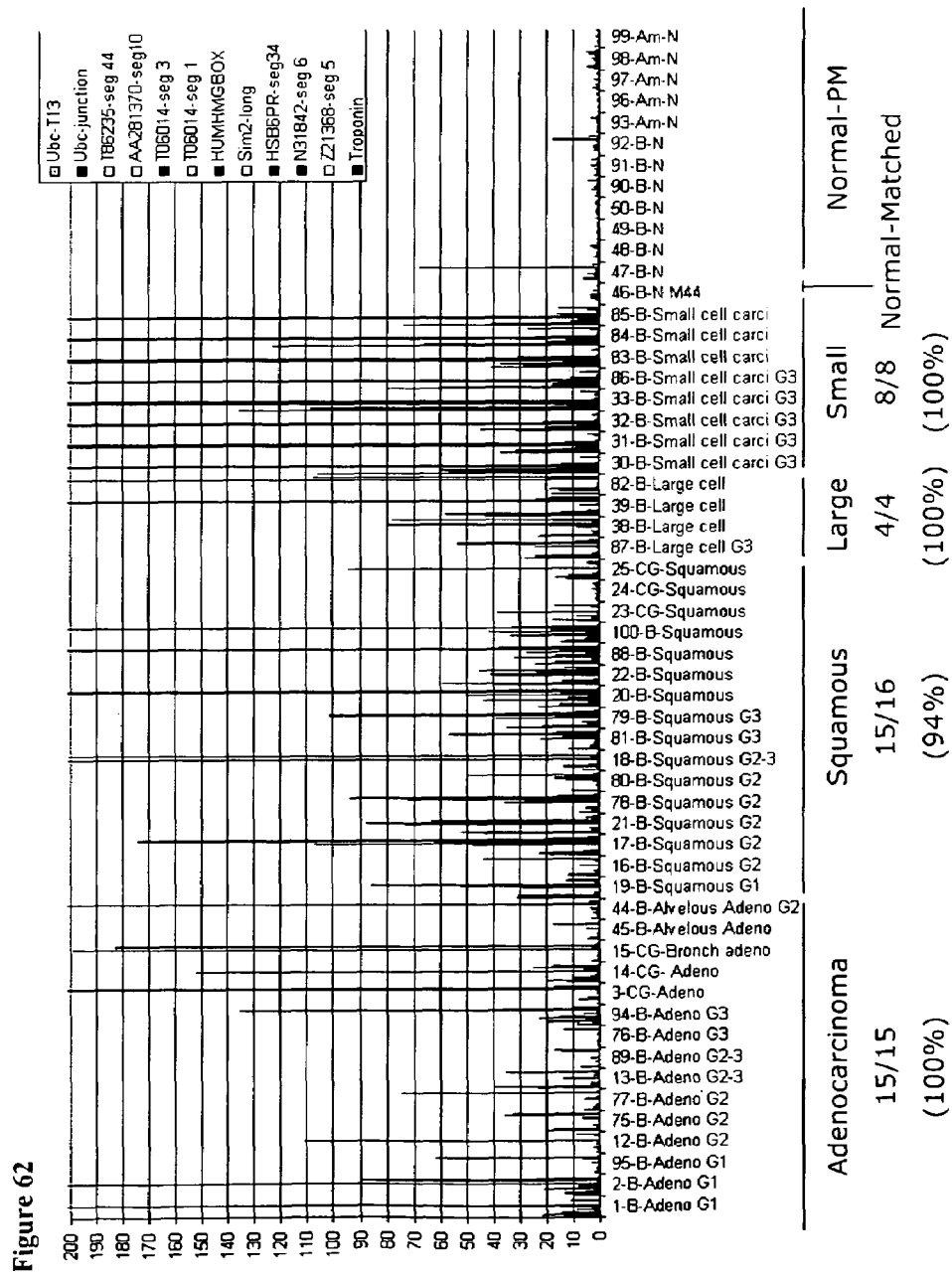
FIG. 62 is a histogram showing the relative expression of transcripts detectable by SEQ ID NOs: 1480, 1517, 1529, 1532, 1558, 1574, 1594, 1600, 1616, 1619, 1622, 1625 in normal and tumor derived lung samples as determined by real time PCR.

FIG. 62 is a histogram showing over expression of the above-indicated transcripts in cancerous lung samples relative to the normal samples. The number and percentage of samples that exhibit at least 10 fold over-expression of at least one of the SEQ IDs, out of the total number of samples tested is indicated in the bottom.

As is evident from FIG. 62, an over-expression of at least 10 fold in at least one of the SEQ IDs was found in 15 out of 15 adenocarcinoma samples, 15 out of 16 squamous cell carcinoma samples, 4 out of 4 large cell carcinoma samples, and in 8 out of 8 small-cell samples.

Statistical analysis was applied to verify the significance of these results, as described below. Threshold of 10 fold over-expression of at least one of the amplicons as depicted in SEQ ID NOs: 1480, 1517, 1529, 1532, 1558, 1574, 1594, 1600, 1616, 1619, 1622, 1625, was found to differentiate between cancer and normal samples with P value of 2.37E-08 as checked by exact fisher test.

The above values demonstrate statistical significance of the results.

Kits and Diagnostic Assays and Methods

The markers described with regard to any of Examples above can be used alone, in combination with other markers described above, and/or with other entirely different markers, including but not limited to UbcH10 (see U.S. Patent Application Nos. 60/535,904 and 60/572,122; attorney refs: 27080 and 28045, filed on Jan. 13 and May 19, 2004, respectively), Troponin (see U.S. Patent Application No. 60/539,129; attorney ref: 26940), Sim2 (see PCT Application No. WO 2004/012847), PE-10 (SP-A), TTF-1, Cytokeratin 5/6, to aid in the diagnosis of lung cancer. All of these applications are hereby incorporated by reference as if fully set forth herein. These markers can be used in combination with other markers for a number of uses, including but not limited to, prognosis, prediction, screening, early diagnosis, therapy selection and treatment monitoring of lung cancer, and also optionally including staging of the disease. Used together, they may provide more information for the diagnostician, increasing the percentage of true positive and true negative diagnoses and decreasing the percentage of false positive or false negative diagnoses, as compared to the results obtained with a single marker alone.

Assays and methods according to the present invention, as described above, include but are not limited to, immunoassays, hybridization assays and NAT-based assays. The combination of the markers of the present invention with other markers described above, and/or with other entirely different markers to aid in the diagnosis of lung cancer could be carried out as a mix of NAT-based assays, immunoassays and hybridization assays. According to preferred embodiments of the present invention, the assays are NAT-based assays, as described for example with regard to the Examples above.

In yet another aspect, the present invention provides kits for aiding a diagnosis of lung cancer, wherein the kits can be used to detect the markers of the present invention. For example, the kits can be used to detect any one or combination of markers described above, which markers are differentially present in samples of a lung cancer patients and normal patients. The kits of the invention have many applications. For example, the kits can be used to differentiate if a subject has a small cell lung cancer, non-small cell lung cancer, adenocarcinoma, bronchoalveolar-alveolar, squamous cell or large cell carcinomas or has a negative diagnosis, thus aiding a lung cancer diagnosis. In another example, the kits can be used to identify compounds that modulate expression of the markers in in vitro lung cells or in vivo animal models for lung cancer.

In one embodiment, a kit comprises: (a) a substrate comprising an adsorbent thereon, wherein the adsorbent is suitable for binding a marker, and (b) a washing solution or instructions for making a washing solution, wherein the combination of the adsorbent and the washing solution allows detection of the marker as previously described.

Optionally, the kit can further comprise instructions for suitable operational parameters in the form of a label or a separate insert. For example, the kit may have standard instructions informing a consumer/kit user how to wash the probe after a sample of seminal plasma or other tissue sample is contacted on the probe.

In another embodiment, a kit comprises (a) an antibody that specifically binds to a marker; and (b) a detection reagent. Such kits can be prepared from the materials described above.

In either embodiment, the kit may optionally further comprise a standard or control information, and/or a control amount of material, so that the test sample can be compared with the control information standard and/or control amount to determine if the test amount of a marker detected in a sample is a diagnostic amount consistent with a diagnosis of lung cancer.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

SEQUENCE LISTING (1780 sequences)

SEQ ID NO: 1 - DNA, 1205 bp, Homo sapiens
ggaggcgctcggggcatccgaggcggggaggcgggtccgccccctattgtgtagcggcgagagtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggtgactgtgggttccctgccttccgagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagccgaaggctcttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatg

SEQ ID NO: 2 - DNA, 715 bp, Homo sapiens
ggaggcgctcggggcatccgaggcggggaggcgggtccgccccctattgtgtagcggcgagagtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggataagagttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagatgtcattcatttacacacacacaca

SEQ ID NO: 3 - DNA, 2875 bp, Homo sapiens
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccagaccagcccaatggcgtgatcctggactatgagctgcagtactatgagaaggtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagtgataattagtcactcacctcttcttcgacagagatttgaaacagctcaagagagcttccgcctgccctgctctgagtcctgctaaaacacccactttcactcgcctgcatgccctttgcatggggagaggtgatttcactttgagcttttaaatcagaccttaattactccctttgggtggaagcccctgggatggtagaaggatcactggactaagagtgagaagccgtaggttcaaatcccagctccgtccttcaccagctatgtgaccttgggcaggcgtctttctccctctgaacctcagtttccacctgtgtcgagtgtgggtgagacccctcgcggggagctatgcaggttacggagaaaaggcagcacagcacccagaatgggacctggccctcagcagaggccatgtgtgtccctggccttcctcctctgccctgcctgctgcacagtgggcaatggtgacaggatgggaggccaagtggatgtggggtctgcacagtacaggggccaggaggtagacagcacaattgcccacccacatggctggacatcagaggccccaggaagcctctcctttgaatgatcacttctcttacctgctccaggaggcaacaaacagccacagaggctgcaagggcacctgggaaaggcatcgcggggcttccattcagactaggtgtcaatgactgacagggaggcctttggttgagggcaagcccacggggaactgcagatggatggaagggctctccctgaaggctgagaggaagagtgcagtcaattgcagccagtcctgctggagcccaactttctagagcccagcccggccttcccactctgttaactgctggatcggctaaccaggccggtctccagggcctttcaaacacttacccagcctttgccggccgtcttaccattgcttgcgtgcgtgttcatccc

SEQ ID NO: 4 - DNA, 1182 bp, Homo sapiens
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgagagagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaattta

SEQ ID NO: 5 - DNA, 2199 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 6 - DNA, 1947 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 7 - DNA, 1592 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 8 - DNA, 2490 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 9 - DNA, 4755 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 10 - DNA, 4677 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 11 - DNA, 2790 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 12 - DNA, 3069 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 13 - DNA, 5384 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctg

SEQ ID NO: 14 - DNA, 4524 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 15 - DNA, 4454 bp, Homo sapiens
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 16 - DNA, 3322 bp, Homo sapiens
gtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccaggtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgcgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 17 - DNA, 2817 bp, Homo sapiens
gtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgcgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 18 - DNA, 248 bp, Artificial
  Synthetic oligonucleotide
gccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagc

SEQ ID NO: 19 - DNA, 285 bp, Artificial
  Synthetic oligonucleotide
cacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatcc

SEQ ID NO: 20 - DNA, 1362 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 21 - DNA, 1376 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 22 - DNA, 902 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggaggcacggtggctcacgcctgtaatcccagcactttgggaggccgagacgggcggatcacgaggtcaagagatggagaccatcccggctaacacgttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatg

SEQ ID NO: 23 - DNA, 1239 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 24 - DNA, 1020 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 25 - DNA, 1737 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 26 - DNA, 1820 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 27 - DNA, 1970 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 28 - DNA, 1745 bp, Homo sapiens
ttatgctcccgcggaggccaagcggactccctgacaggacagaatctgaacgtgagagtgaaggtcttgcctgtccagaaactcttgtagccagcacaggtttaaacaagaagccaaattgttctggagagattgctgggggctttctttgtgcctcaagcttcttcagtgccctgagcacaggaaacactcaagcagagaagcagagccaaacccaggatacgggaggtcgaggctcttccgtagacctgcagcattggggtgggatgatgttcattctgtgtgtgttctggaccaagcccctctccagggacctatgggcagccccctttaagcaagatgcccggtggagtgggcatccaccatcacttaccctgggcttgggtgaatagattttccgtgccttaaatgggcagggagggggtaaacatggacggtccattggtacaaataaaagcctttggtgggttttgatcaattgcaaggatcgaaggagacctgtggacctgaggtcaactggcagcagagaagagtctgggttcgtgaaggcgccgccgcggtgccgcgccacgtatttgcataaaaaaggccaagaaaactctggctgtgccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaaggtaagccttccctcttgcttccccactccctgctgggctgagacgctcccaggagatcccgcccctgccacgcatcccagtgcatccctgcttggggtgccagtagcgggaagggcagaagttctgcctgacctggtctgtcatcacaacaagcctgtatcaaatttgaggcacccctcccacgccgcccaagtctcgcgcattctcctcccgagttgtaccagctatacttaagggcagtttaaaaataaaacaaacaaacaaaaacaacaaaactaaaaaaacgaagaactgaacggcggtttaaaaaaaaatagatacacgattattgttaaagatgctagcactggagctgcgcagagcgttggaagtggtgtttggtggagg

SEQ ID NO: 29 - DNA, 3170 bp, Homo sapiens
gactgggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaaggtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtcttttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaatgga

SEQ ID NO: 30 - DNA, 4161 bp, Homo sapiens
gactgggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaaggtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtcttttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaatgga

SEQ ID NO: 31 - DNA, 2546 bp, Homo sapiens
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcagggagttcatcccaaaatgatcagtaatctgcaagtgttcgccataggcccacagtgctccaaggtggaagtggtgtaagttctgtgctgctgtgtccgctgtgaccttggcaagagagaaatcccgcagcctgggtcttcaaccttggtatctcatgagtgtatcttctttttctttccttcagagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggtt

SEQ ID NO: 32 - DNA, 1893 bp, Homo sapiens
gacgtcggcccgccggcgccccaccagctccgcgcgggcccgggttggccaccgccgggcccccgcccctcccccggcggtgtcccggccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggca

SEQ ID NO: 33 - DNA, 1069 bp, Homo sapiens
gcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccagtctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaattaat

SEQ ID NO: 34 - DNA, 1507 bp, Homo sapiens
ggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagcctacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatc

SEQ ID NO: 35 - DNA, 4902 bp, Homo sapiens
ccttgctgttcatggcccagcaggggccctatgggggtcaggcctgcaggcactcacacttggcacctgctccaaaaccctttcaggtctttgaggatctgagccctgggcctgggtctcccgccggctcggaaaagctggcctgccgggccagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcaggtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgccccactccctctgctgcccagaaacctgataaactccttccttcgcaggtgctggaaggcaccacaggtttggctctttaaaatcagagccactgttaaccaaggcgggcagcagtgttaagaccaccagcaccctgaaccagccctgtacttactgggcactgtttccttaaaatcagaaggtggcttcccatctctggtttcctggggtcttatgtctgtcctcggagggagaatccagttcctagctcccctgtaccatgcgaaggtagcctgtcctgtctcactcctcagatacgcagagtctgtttacacatttgcctgcatagcatgatcaggaagcacacacacacacacacacacacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgcctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccacactctgtcaccctccaggccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgcttttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttctggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccagggtctacgaagaatagggtgaaaaacctcagaagggaaaactccaaaccagttgggagacttgtgcaaaggactttgcagattaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaccaaaattctaga

SEQ ID NO: 36 - DNA, 3429 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 37 - DNA, 5165 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 38 - DNA, 3575 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacagaagtaagagaaacctgtgatggccagagcccagatgttcttaggaggcaagccaggagaagccgggtctgacttttcagctcagagacagcactcccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 39 - DNA, 2397 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagca

SEQ ID NO: 40 - DNA, 2206 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagctactgtggttgagaggaaaggtgtctttttattgcttctagagacgttgaaagtgtgacctgagcacctcataatcatgtgaaaaagacactcaaaaactaccatttgaatggatggatgaaaataacctccgtatattctacgaagatgtttaataataaataggtttcgttataagagaatgtgtgtcacttcgtctcttccctcacccccgagacttagtgacagttatttttgacttttccaactatactatttgcctagaaaatgtgtctattaaatagcgtattgagaaat

SEQ ID NO: 41 - DNA, 1173 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 42 - DNA, 1104 bp, Homo sapiens
gcacacacgcgaggggaccctgggtgggcaaaaacgtgctttcccggacggggttgaaggggagaaagggagaggtcgggcttggggggctgcctcccgcggctcagcagttcctctgaccatccgaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 43 - DNA, 1105 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 44 - DNA, 1466 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggttgctgtctctctccttcccactatcgtccgcacagcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccctgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccagggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 45 - DNA, 1354 bp, Homo sapiens
gcacacacgcgaggggaccctgggtgggcaaaaacgtgctttcccggacggggttgaaggggagaaagggagaggtcgggcttggggggctgcctcccgcggctcagcagttcctctgaccatccgaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccctgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccagggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 46 - DNA, 1171 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagacgccaaggagcaacacacgcaccagggtaggctggagaaaccagaacccgggaatcccgcctccctcaacttgaaacttgggaatagtgtattctcttttcaacacttgcactagtagaaggttaattacatgaaagattaggcaaaatgtatggctatgtgtcctggttttccaataaaagtattgagtttctctggggaaagtgcagataaaatgcttagtggaggctgggcgctgtggcttatgcctgtaatcccagcactttgggaggccgaggcaggcaggcagatcacaaggtcaggagtttgagaccggcctggccaatatgatg

SEQ ID NO: 47 - DNA, 953 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggtgctcaccaatgccccaggcatcaggctcctgggctgcctctccatgcctcccacacccaccctagctctggccgattctcctgcagcactgagcccattcctctccccagaaacttccaagccatgctcaaccgcagctcccacggaaacccctctgggggttcctctggtgggcctgccctggcacctgcgtgtcccccaacacacatgccctgaaagaagtgggcccagcatccggaggagccccggcagccccagactgggcgtgttccctgtatcaggaatcccttccctct

SEQ ID NO: 48 - DNA, 3110 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacaggtgagggtcacagtctgcccatcagtcctggagttcttcagacccagaattgcgggccttgaaggccagtgtcctggaagggaggcaggtgtgagcctgcaagtgtgcatgcccagccatggtatggacatgtgtctctgggcatgtaaatgtgaaccagtgtgaacaggctccgtctgcatgctgagtgtgcatgtgggagcccgtggctgtgccgtggcaacgtgccattctctgagccagcgaatggcagtgtgttgggaggtctgagaaggcagctgcatccgtgcctctgggaggattcggttctcccccagcttgccgaggccctgcctgatggtctgacacgaggcacagctgctgcagctgcagatggacagaagggcttcccagaggtggaccccaggcctccccactctccctgtggctggctgcactgcatgctggggggtgtagttcttgcagcttccaggcctaatctgatgccggagcatttcctgcctgaggaagcgccaggcattggtttcggaggcaaacccaaacattctctttgaccccaaacctccagatcctagatccagactgtaagccctaacacttcactccacctcagatctatccaaagcccccagcaccagcccacccacctcagtcagagaaccaggaccccaaaggcatgcagagcccccacttccccactgtcttggccagccagggaccccagaagagaggttacaacccttcaggaatagggacaagctgctccctttgtaagaggatgtgagggaggctggctgggcccctgccagcaaacacaaatgaccctgcggcctggctcttctctctcctcccagctgcggcccttgcagctctgctcctggcacagagacaggagctactggctgagtgtaacagctggagggatggagggggaggggaggacgctccactccacgccagacagccccttctgcttgcaaatgagttagatccccatgcttctcctttcttctctccctcactcagtatcctcactcgaaagtctttgatgctggaaggtcatcccagccattctgctgctgctacacaggcccagccctaaacaaaataaccggggttctttggtcccaaaagatccccaggaaagagtaaacctccttaagacttaaggaaaaaagttggctaggcgtggtggctcacacctgtaatcccagcactttgggaggccgaggtgggcagaccacttgagatcaggagttcgagaccagcctggccaacgttgtgaaaccccgtctctacaaaatattagccgggtgtggcagtgcgtgcctgtagtcccaactactcaggaggctgaggcacaagaattgcttgagcctgggaggcggaggttgcagtgagccgagatcgtgccactgcactccagcccaggcgatggagcgagactctgtcccgcaaaaaaaaaaaaaaaaaa

SEQ ID NO: 49 - DNA, 1903 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctgaggagagacttcacctgggacgtgaaaggagcatgggcttgatgtcagacagctgtgaccctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaccctgacc

SEQ ID NO: 50 - DNA, 2364 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctaaccagcccctccccgcacgccccctgcccaccccccacctcccactccaggagctgaacagagacttgcccagctgcccaaagccagccccgaactcctggggggccaggggagcccagggcagccacgacttggctttgtgttttatttcctc

SEQ ID NO: 51 - DNA, 3125 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccagggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 52 - DNA, 3263 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagcctggacttgaaaggggagcagacaaatttcctgtcgttgggggaagttccctcttcttggccctggatctgaccctgaggcctcctgtagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 53 - DNA, 3256 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 54 - DNA, 3164 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 55 - DNA, 2886 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 56 - DNA, 3100 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 57 - DNA, 3254 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatggtaaggctggggtgtgaggatggaggaagaaaggaggggtgaactgggcgggcccagactgagcggggtgctcccacccacagagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 58 - DNA, 1533 bp, Homo sapiens
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgcag

SEQ ID NO: 59 - DNA, 6659 bp, Homo sapiens
tgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 60 - DNA, 6333 bp, Homo sapiens
ggctgcagtggccgccgctggagaccgcgggacctggcgctgcagcgagattttcaaacaccgcattccccttaaacctcccaggctcccatcactcccagcaaagagccagcccgctactttatggagacaggagagactgtcagacagttcctgctgctgcccaggtgcatctgagagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 61 - DNA, 6297 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 62 - DNA, 3466 bp, Homo sapiens
tcctgagctcaggcaacctgcccgcctcggcctcccagagtgctgggattacaggcatgagccacggtgcccagcccagatgggttctcactttattgttcaagctggtctgaaactcctggcctcgagcaagcctcccaagtgctgggattacagggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 63 - DNA, 3580 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgag

SEQ ID NO: 64 - DNA, 1786 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 65 - DNA, 7128 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatgattttctagcagcacacgtgtttggaaagctactagaataattgaataattcagcacctgaggctggtggatgattctttgcaatttggcaggaatgggagagtcgggagcagtagttggcaaggtggggagtagccatatgaagttttatttcgggaatcctccaggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 66 - DNA, 7004 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggcccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagggtatgaaatcaaggcttaggtgcaaagccattggataccatacctgagaccacacagccaagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 67 - DNA, 5977 bp, Homo sapiens
gctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 68 - DNA, 5999 bp, Homo sapiens
ggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 69 - DNA, 6038 bp, Homo sapiens
gctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagggtatgaaatcaaggcttaggtgcaaagccattggataccatacctgagaccacacagccaagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 70 - DNA, 5044 bp, Homo sapiens
aagcttccctggcttgtgcctttcaaatggactctgggttttccttctggtagtgcatagctgttcctttacaggcgcttaggcgtggctctaggaaaggttttatgagtcctgggctgatgtaaatgttgaccaaacaccctcaaccagatggcgagtttctgtttgcagcagagcccaggctgtcttttcttcataattctctctgtgcccactcctcgagggcaggaactgtccctgtatcagtgaggcattcggacttgggagatgtttttagaacatcagaccagaaatgagggaaggtggaaatggccaaatcaggttccccaagtgactgcatgccatccgaggggccgaggaagcagagttcttctgacatgggctctctgttttaaaatatcagcccttctcccatctcattatttttcccctgaagctcttgcacaagcaaactataaatacatcctcaaagccttatgtttcatgactcttagatgcaccccagaaattagttttcacttgggcacggaggaagctgtgaggctgttctgtgatccctccaaatcctgcagaattactgcctttattgtacagagctaatagggttggaacagaaccacggttttagcctgatgactcagaatttcagactgatgtggaatatattgctttttcctctcaatttcagtttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 71 - DNA, 2945 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggagtgagtcggcccagggcaccaggggtgtgggggtggtcatgcctcggtcctcttggggaagcctggaaggatgtggctcttagtcgagggccctgctcaccttgccctgtgggcactgccctggtgacacagcaggctgggcgggctgcttccaaggtctgttctccgatctggagctgagcctcctggagccctggcatggcaggtggcaggcgggcccagctgcctctcctagtccccgagggccagggtcacataggtgattccgctggatggacgcatgccccagtagatgggggggagcatctgtaatgaaagcaccaaaaaaaaaaaaaaaaaa

SEQ ID NO: 72 - DNA, 2261 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgaggtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatttagaaaataaatgtctgactttcaaaaacccctgatgttttgagattgagtagccagtggctacagttcgttctggaagggcagagacctttggttgggtgatcaagcaaggatgatccttttttatttttatttttttgagacagggtctctctgttgtccaggctggaatgcagtggtgcaatcatggctcactgcaacctccagagctcaaatgatcttcccgcctaagactctcaagtagctaagactacaagaatgtgccaccatacctagctaattttttaatattttgagacagagtttctctatgttggtcagggtgatcttg

SEQ ID NO: 73 - DNA, 1059 bp, Homo sapiens
aagcttccctggcttgtgcctttcaaatggactctgggttttccttctggtagtgcatagctgttcctttacaggcgcttaggcgtggctctaggaaaggttttatgagtcctgggctgatgtaaatgttgaccaaacaccctcaaccagatggcgagtttctgtttgcagcagagcccaggctgtcttttcttcataattctctctgtgcccactcctcgagggcaggaactgtccctgtatcagtgaggcattcggacttgggagatgtttttagaacatcagaccagaaatgagggaaggtggaaatggccaaatcaggttccccaagtgactgcatgccatccgaggggccgaggaagcagagttcttctgacatgggctctctgttttaaaatatcagcccttctcccatctcattatttttcccctgaagctcttgcacaagcaaactataaatacatcctcaaagccttatgtttcatgactcttagatgcaccccagaaattagttttcacttgggcacggaggaagctgtgaggctgttctgtgatccctccaaatcctgcagaattactgcctttattgtacagagctaatagggttggaacagaaccacggttttagcctgatgactcagaatttcagactgatgtggaatatattgctttttcctctcaatttcagtttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaagtgagttctctttgtctgaatgggactgagaagaaaatcaaagatggcagggaagaatcattttcagttgaaatatcacttgcttaagtcggggctggttatgcttaaaaattaattactgcacaccagagaatgt

SEQ ID NO: 74 - DNA, 2715 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 75 - DNA, 2931 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 76 - DNA, 3190 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 77 - DNA, 2385 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 78 - DNA, 2577 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggtaagaggaggaacagccgggtacctaggggaagagaccagaggtcagcggccaggctgtgattcccaaagccacacaggaccctcaaagaagccctctgccccatctcctctccctgcaggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 79 - DNA, 2297 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 80 - DNA, 2457 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 81 - DNA, 4104 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgctcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 82 - DNA, 1795 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 83 - DNA, 2175 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 84 - DNA, 1956 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 85 - DNA, 1804 bp, Homo sapiens
ttttgagacagagtcttgctctgttgcctaggctaaagtgcagtagtgcgatctcggctcactgcaacctccacttcctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 86 - DNA, 838 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 87 - DNA, 606 bp, Homo sapiens
tccgggcgcggaggtttgcgcgccttggtgagccgttggcgtggtggtcccggagtgatcctggcagccggtggggaagacaaggagggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 88 - DNA, 698 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 89 - DNA, 733 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcagctttgtttttgggaggctgaggaaggaggatcatttgagcctgggaggttaaggctgcaataagctgtgactgtgccaccatccttcagaaaaaaaaaagaaaaaggaaaagaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 90 - DNA, 746 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 91 - DNA, 782 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 92 - DNA, 627 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 93 - DNA, 917 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 94 - DNA, 952 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcagctttgtttttgggaggctgaggaaggaggatcatttgagcctgggaggttaaggctgcaataagctgtgactgtgccaccatccttcagaaaaaaaaaagaaaaaggaaaagaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 95 - DNA, 1001 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 96 - DNA, 846 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 97 - DNA, 4539 bp, Homo sapiens
gctacggaagggttttcagcagggagagatgggaccagcatgctctccatcctgttgccccgcctcacgtctggcccctgcttctccagtcccccaccccagaccacacacgaagaagcagtcctgtcctcagcccagccctcacctcccccgacctgccatcctgcttcatgctcagggcggtgtgtggagcgcccggggctctggacccgcgctgccagataacaatgctctcgttgtctctttgctcccatctctgggggcctctgattctttctgctctacaggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcccagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtga

SEQ ID NO: 98 - DNA, 968 bp, Homo sapiens
gctacggaagggttttcagcagggagagatgggaccagcatgctctccatcctgttgccccgcctcacgtctggcccctgcttctccagtcccccaccccagaccacacacgaagaagcagtcctgtcctcagcccagccctcacctcccccgacctgccatcctgcttcatgctcagggcggtgtgtggagcgcccggggctctggacccgcgctgccagataacaatgctctcgttgtctctttgctcccatctctgggggcctctgattctttctgctctacaggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggaggtgggcctgggcagggggcttggagattccgagtgggtgagggggtgcgtgtgccaccacgcccagcacagagagattttagatggcaaccgtgtggcatctgctgtggaggatgaaggtgcagaggtggatggggaagccttcaggtggggaagcctttgggtgggagagtcctgggacatgtga

SEQ ID NO: 99 - DNA, 3615 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttgtaagtatgatgataataaatagccagacaatcatggttgtgaattacagctcttctttcattactctcatgctgtgattccacagtgtgtgggagagaaaataaacacatgtcaatcaaatcagtcaa

SEQ ID NO: 100 - DNA, 2648 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcata

SEQ ID NO: 101 - DNA, 3475 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaagtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtctttttccctgatctccactgtgagattccttgagtaatattttgtcccctgtagtcatagcacatttctatctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacagatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 102 - DNA, 1271 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatagcagtgcagtttttgaacttatacttatttattccattttaattaagctatgctttgtattttaattgtgttgtaatatttccaggaaaaagtgacttgaatatatttggtacttgttttc

SEQ ID NO: 103 - DNA, 1225 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 104 - DNA, 1210 bp, Homo sapiens
tgtctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 105 - DNA, 1192 bp, Homo sapiens
cttggctggaggctctgcgaggacagctggggagaaggggagctgtgcccagatttaccaaagggaattgtcagctgtccaagggctagcaaattcctaggtcacctagattggattttctgaccataaaaactgtgggccaggtgcacagctgcctgaggggctcaaacctgtgcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 106 - DNA, 1177 bp, Homo sapiens
cttggctggaggctctgcgaggacagctggggagaaggggagctgtgatggaggctcgctctgttgccaggctggagtacagcgatctcggctcactgcaacctctgcctcccgggttcaagtgattctcctgcctcagcctcccaagtagctgggactacagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 107 - DNA, 1051 bp, Homo sapiens
gccttatttctctgctggttgagcgaagggattgtcttccatggtctccgagatcccgtcccacgctcatgccctagaattctctgagtccttgatgcacttttgcctttggcgaggaggcaggacagtcaggcgtggaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 108 - DNA, 1267 bp, Homo sapiens
tcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 109 - DNA, 3897 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctgtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 110 - DNA, 3347 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacactttttccccaaatgagaggaggaagccccttggatgaggcaggagcagctcagactctgctccctgctctgcgcccggctcacccggtgactggctctgccctggctccacttggggtgggaccggggcatgtggagaaggtgtccaggtggcctgttttgaatctgggtaaatcaagctgccaatccacagcagagcctcccttgggtcaggttgcagggaaatgggaaaagagggagcctcgggacagactcctgagctgtgtcctggctctgaagtcactggctgtatgaggctgtggacacagcacataggacacagcagaggaaagtgagtgacacacacttggagaaatagggagattcagccataggggctctgcatgggagggaacaggcagtgccaaaaagtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaaaaaaaaaaaaaaagg

SEQ ID NO: 111 - DNA, 1886 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 112 - DNA, 2429 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 113 - DNA, 2429 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 114 - DNA, 3898 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 115 - DNA, 3774 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 116 - DNA, 3998 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcgtacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 117 - DNA, 4071 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcgtacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggtcaggcgggggcggggcctgcggggtgggcagggggggccgggcatccctctctgacggctctccgtccacaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 118 - DNA, 4138 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcgtacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggtcaggcgggggcggggcctgcggggtgggcagggggggccgggcatccctctctgacggctctccgtccacaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 119 - DNA, 1250 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtc

SEQ ID NO: 120 - DNA, 1292 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 121 - DNA, 886 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 122 - DNA, 696 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 123 - DNA, 706 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaagaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 124 - DNA, 560 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 125 - DNA, 3194 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 126 - DNA, 2705 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 127 - DNA, 3332 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 128 - DNA, 3052 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 129 - DNA, 2359 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggaggtgaggccctgcctgccagtccccctactcctctgctggccactgtgactgcagcatatgccctcagcatgtgtccctctctcccaccccagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 130 - DNA, 2077 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 131 - DNA, 1266 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtggaaagtgcatcttcctaagggcgagggtttcagcagtggttgaactcggcggggtggggcggagcgggaggatgcaaacttgcaaagtgaagcaaacacactcaccgcagcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 132 - DNA, 747 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccga

SEQ ID NO: 133 - DNA, 2201 bp, Homo sapiens
tgagacaagatgtcactctgtcacccaggctggagtgcagtggcaggatcacggctcactgcagcctcgacctccctgggctcaggtgatcctcccacctcagcctaccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtagaaaatgtaaaaatagataaatatggagggaagaaatcccccctggaatacagacgcttcctctcccttccagccttttccccatatgaacattgctgtgagtgagacttacatgcaatgtaatttctttttgagcttaacattacaacataaattctcaaactctgatgttcattaaacaccccagccccatcctgggaacttgggcttggggctcggggtgttctgataatgatcaaagtatgagaattgaacccatgaggactttgatccaagatactggggtgtggggaggggcaggcacaggtgtcctgggaacacactttgagaagcaatggcaaagctgggggtccagctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggcattgcgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctggacacacagctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcacaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 134 - DNA, 5503 bp, Homo sapiens
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaatgctacaagatagaaattactatgcccaagaggaggaaagtgaagctaagagattagagaactcggactgagaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggct

SEQ ID NO: 135 - DNA, 1919 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacacttgcttccttctcccacatgtcagatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 136 - DNA, 1743 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 137 - DNA, 1749 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 138 - DNA, 1769 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 139 - DNA, 1522 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaaaaagatctcgctctgttgcccaggctggagtgcagtggtgtgatcacgactcaccgcagccttgacctcccacactcaagcaatcctcctgccttagccttccaagtagctggaactccaggtggtggttaattttatgtgtcaacctggctggaccactgggtactccgatatttggtcaaacattattctgag

SEQ ID NO: 140 - DNA, 1414 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 141 - DNA, 1846 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 142 - DNA, 1769 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaactttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 143 - DNA, 378 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcaggtaagcatcttttatgtttttatatagttaaatcatttactcaattatggcgagaggtgcaagaaacgtatttgctgcgatattact

SEQ ID NO: 144 - DNA, 1295 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccggttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 145 - DNA, 1367 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 146 - DNA, 1520 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 147 - DNA, 1371 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacagggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 148 - DNA, 2213 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 149 - DNA, 2247 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 150 - DNA, 876 bp, Homo sapiens
gtggaggaggatggtggggagtggtggtgtcttcgtcctgggagaaggcgaagcaacttccaggaggaaacgggcgtttccttcccacgcgctcgagcgagccctgggtcctggcctcggaactccacccagcccctccccaccctctgggaaaagccagtcgccacacacaggcacacgcaggccccggcgccgcgccctaaggagagcagcacccacagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatctacagcgaagaaagtctcgtttggtaaaagcgagaagggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccagtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacgggtaatcctgctccctctgctgtttgacctcttctcctgcagctaagtgaagctgcttcctcccttctcttttgtattccccttcccagagggcgataagcaaataataataatgcaataaat

SEQ ID NO: 151 - DNA, 232 bp, Artificial
  Synthetic oligonucleotide
atctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacg

SEQ ID NO: 152 - DNA, 189 bp, Artificial
  Synthetic oligonucleotide
gtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgg

SEQ ID NO: 153 - DNA, 201 bp, Artificial
  Synthetic oligonucleotide
gttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagatgtcattcatttacacacacacaca

SEQ ID NO: 154 - DNA, 698 bp, Artificial
  Synthetic oligonucleotide
gtgactgtgggttccctgccttccgagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagccgaaggctcttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatg

SEQ ID NO: 155 - DNA, 86 bp, Artificial
  Synthetic oligonucleotide
ggaggcgctcggggcatccgaggcggggaggcgggtccgccccctattgtgtagcggcgagagtggagccgagcggtgcggagcag

SEQ ID NO: 156 - DNA, 7 bp, Artificial
  Synthetic oligonucleotide
gataaga

SEQ ID NO: 157 - DNA, 203 bp, Artificial
  Synthetic oligonucleotide
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaag

SEQ ID NO: 158 - DNA, 229 bp, Artificial
  Synthetic oligonucleotide
agagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaattta

SEQ ID NO: 159 - DNA, 336 bp, Artificial
  Synthetic oligonucleotide
ccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcag

SEQ ID NO: 160 - DNA, 125 bp, Artificial
  Synthetic oligonucleotide
ctccatcggcagtgtccatcatgcatcaggtgagccgcaccgtggacagcattaccctgtcgtggtcccagccagaccagcccaatggcgtgatcctggactatgagctgcagtactatgagaag

SEQ ID NO: 161 - DNA, 1305 bp, Artificial
  Synthetic oligonucleotide
gtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagtgataattagtcactcacctcttcttcgacagagatttgaaacagctcaagagagcttccgcctgccctgctctgagtcctgctaaaacacccactttcactcgcctgcatgccctttgcatggggagaggtgatttcactttgagcttttaaatcagaccttaattactccctttgggtggaagcccctgggatggtagaaggatcactggactaagagtgagaagccgtaggttcaaatcccagctccgtccttcaccagctatgtgaccttgggcaggcgtctttctccctctgaacctcagtttccacctgtgtcgagtgtgggtgagacccctcgcggggagctatgcaggttacggagaaaaggcagcacagcacccagaatgggacctggccctcagcagaggccatgtgtgtccctggccttcctcctctgccctgcctgctgcacagtgggcaatggtgacaggatgggaggccaagtggatgtggggtctgcacagtacaggggccaggaggtagacagcacaattgcccacccacatggctggacatcagaggccccaggaagcctctcctttgaatgatcacttctcttacctgctccaggaggcaacaaacagccacagaggctgcaagggcacctgggaaaggcatcgcggggcttccattcagactaggtgtcaatgactgacagggaggcctttggttgagggcaagcccacggggaactgcagatggatggaagggctctccctgaaggctgagaggaagagtgcagtcaattgcagccagtcctgctggagcccaactttctagagcccagcccggccttcccactctgttaactgctggatcggctaaccaggccggtctccagggcctttcaaacacttacccagcctttgccggccgtcttaccattgcttgcgtgcgtgttcatccc

SEQ ID NO: 162 - DNA, 404 bp, Artificial
  Synthetic oligonucleotide
tgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggc

SEQ ID NO: 163 - DNA, 184 bp, Artificial
  Synthetic oligonucleotide
cttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaag

SEQ ID NO: 164 - DNA, 97 bp, Artificial
  Synthetic oligonucleotide
ctctactgtaacggggacggcgagtggctggtgcccatcgggcgctgcatgtgcaaagcaggcttcgaggccgttgagaatggcaccgtctgccgag

SEQ ID NO: 165 - DNA, 91 bp, Artificial
  Synthetic oligonucleotide
gttgtccatctgggactttcaaggccaaccaaggggatgaggcctgtacccactgtcccatcaacagccggaccacttctgaaggggccac

SEQ ID NO: 166 - DNA, 65 bp, Artificial
  Synthetic oligonucleotide
caactgtgtctgccgcaatggctactacagagcagacctggaccccctggacatgccctgcacaa

SEQ ID NO: 167 - DNA, 65 bp, Artificial
  Synthetic oligonucleotide
aaacgctaatggactccactacagcgactgctgagctgggctggatggtgcatcctccatcaggg

SEQ ID NO: 168 - DNA, 810 bp, Artificial
  Synthetic oligonucleotide
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctgg

SEQ ID NO: 169 - DNA, 168 bp, Artificial
  Synthetic oligonucleotide
gtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 170 - DNA, 157 bp, Artificial
  Synthetic oligonucleotide
ggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagg

SEQ ID NO: 171 - DNA, 198 bp, Artificial
  Synthetic oligonucleotide
agtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcg

SEQ ID NO: 172 - DNA, 153 bp, Artificial
  Synthetic oligonucleotide
ggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctg

SEQ ID NO: 173 - DNA, 140 bp, Artificial
  Synthetic oligonucleotide
gccatcccgcgccacgtggctgtccttgttctccagtgaggagagcaacttgggagccaacaactatgatgactacaggatggactggcttgtgcctgccacctgtgaacccatccagagtgtcttcttcttctctggag

SEQ ID NO: 174 - DNA, 127 bp, Artificial
  Synthetic oligonucleotide
acaagtactaccgagtcaatcttcgcacacggcgagtggacactgtggaccctccctacccacgctccatcgctcagtactggctgggctgcccagctcctggccatctgtaggagtcagagcccac

SEQ ID NO: 175 - DNA, 223 bp, Artificial
  Synthetic oligonucleotide
tgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggataga

SEQ ID NO: 176 - DNA, 9 bp, Artificial
  Synthetic oligonucleotide
ctgaccaag

SEQ ID NO: 177 - DNA, 44 bp, Artificial
  Synthetic oligonucleotide
ggagacctcagcccccagcagaggaggagctgtgcagtgggaag

SEQ ID NO: 178 - DNA, 38 bp, Artificial
  Synthetic oligonucleotide
cccttcgacgccttcaccgacctcaagaacggttccct

SEQ ID NO: 179 - DNA, 14 bp, Artificial
  Synthetic oligonucleotide
ctttgccttccgag

SEQ ID NO: 180 - DNA, 32 bp, Artificial
  Synthetic oligonucleotide
ggcagtactgctatgaactggacgaaaaggca

SEQ ID NO: 181 - DNA, 24 bp, Artificial
  Synthetic oligonucleotide
gtgaggcctgggtaccccaagctc

SEQ ID NO: 182 - DNA, 84 bp, Artificial
  Synthetic oligonucleotide
atccgagatgtctggggcatcgagggccccatcgatgccgccttcacccgcatcaactgtcaggggaagacctacctcttcaag

SEQ ID NO: 183 - DNA, 42 bp, Artificial
  Synthetic oligonucleotide
ctggtaccagacagccccagttcattagccgggactggcacg

SEQ ID NO: 184 - DNA, 51 bp, Artificial
  Synthetic oligonucleotide
gtgtgccagggcaagtggacgcagccatggctggccgcatctacatctcag

SEQ ID NO: 185 - DNA, 9 bp, Artificial
  Synthetic oligonucleotide
gcatggcac

SEQ ID NO: 186 - DNA, 95 bp, Artificial
  Synthetic oligonucleotide
cccgcccctccttggccaagaaacaaaggtttaggcatcgcaaccgcaaaggctaccgttcacaacgaggccacagccgtggccgcaaccagaac

SEQ ID NO: 187 - DNA, 42 bp, Artificial
  Synthetic oligonucleotide
agtcatgcaagggccgctgcactgagggcttcaacgtggaca

SEQ ID NO: 188 - DNA, 8 bp, Artificial
  Synthetic oligonucleotide
tcccgccg

SEQ ID NO: 189 - DNA, 7 bp, Artificial
  Synthetic oligonucleotide
atggccg

SEQ ID NO: 190 - DNA, 17 bp, Artificial
  Synthetic oligonucleotide
ggccctctgtagctccc

SEQ ID NO: 191 - DNA, 62 bp, Artificial
  Synthetic oligonucleotide
tcctcccatctccttcccccagcccaataaaggtcccttagccccgaaaaaaaagckataat

SEQ ID NO: 192 - DNA, 20 bp, Artificial
  Synthetic oligonucleotide
agaagtgccagtgtgacgag

SEQ ID NO: 193 - DNA, 58 bp, Artificial
  Synthetic oligonucleotide
ctctgctcttactaccagagctgctgcacagactatacggctgagtgcaagccccaag

SEQ ID NO: 194 - DNA, 6 bp, Artificial
  Synthetic oligonucleotide
ctcaag

SEQ ID NO: 195 - DNA, 20 bp, Artificial
  Synthetic oligonucleotide
gcctgagacccttcatccag

SEQ ID NO: 196 - DNA, 327 bp, Artificial
  Synthetic oligonucleotide
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcag

SEQ ID NO: 197 - DNA, 177 bp, Artificial
  Synthetic oligonucleotide
aactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaa

SEQ ID NO: 198 - DNA, 240 bp, Artificial
  Synthetic oligonucleotide
ggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacag

SEQ ID NO: 199 - DNA, 300 bp, Artificial
  Synthetic oligonucleotide
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggctttt

SEQ ID NO: 200 - DNA, 152 bp, Artificial
  Synthetic oligonucleotide
ccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaag

SEQ ID NO: 201 - DNA, 176 bp, Artificial
  Synthetic oligonucleotide
ctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaat

SEQ ID NO: 202 - DNA, 129 bp, Artificial
  Synthetic oligonucleotide
agtcccacagatcgttctcaacattgacttggcccccacgatcctggatattgctgggctcgacacacctcctgatgtggacggcaagtctgtcctcaaacttctggacccagaaaagccaggtaacag

SEQ ID NO: 203 - DNA, 279 bp, Artificial
  Synthetic oligonucleotide
gtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcag

SEQ ID NO: 204 - DNA, 50 bp, Homo sapiens
ccccagcttttatagagcggcccaaggaagaatatttccaagaagtaggg

SEQ ID NO: 205 - DNA, 50 bp, Homo sapiens
gacatctttgcatatcatgtcagagctataacatcattgtggagaagctc

SEQ ID NO: 206 - DNA, 50 bp, Homo sapiens
gtcatgaaaatcaacaccgaggtgcggagcttcggacctgtgtcccgcag

SEQ ID NO: 207 - DNA, 50 bp, Homo sapiens
agttcatccttcttcagtgtgaccagtaaattcttcccatactcttgaag

SEQ ID NO: 208 - DNA, 50 bp, Homo sapiens
gctgatatggaagttggggaatctgaattgccagagaatcttgggaagag

SEQ ID NO: 209 - DNA, 50 bp, Homo sapiens
tctcatagaagcaaaggagaacagaaaccaccagccacctcaacccaagg

SEQ ID NO: 210 - DNA, 50 bp, Homo sapiens
tctgacttttacggacttggcttgttagaaggctgaaagatgatggcagg

SEQ ID NO: 211 - DNA, 50 bp, Homo sapiens
acgggagggaaggaaggtgtgcgggaggagttctctgtctccactcccct

SEQ ID NO: 212 - DNA, 50 bp, Homo sapiens
caaggggaactgaccgttggtcccgaaggtctagaagtgaatgggagcag

SEQ ID NO: 213 - DNA, 50 bp, Homo sapiens
ctgggcttggacttcggagttttgccattgccagtgggacgtctgagact

SEQ ID NO: 214 - DNA, 50 bp, Homo sapiens
tcttagcaggtaggtgccgcagaccctgcgggttaagaggtggggtgggg

SEQ ID NO: 215 - DNA, 50 bp, Homo sapiens
cgtaattgcagtgcatttagacaggcatctatttggacctgtttctatct

SEQ ID NO: 216 - DNA, 50 bp, Homo sapiens
tgaagagtgtgaggaaaacctatgtttgccgcttaagctttcagctcagc

SEQ ID NO: 217 - DNA, 50 bp, Homo sapiens
ccaaggctcgtctgcgcaccttgtgtcttgtagggtatggtatgtgggac

SEQ ID NO: 218 - DNA, 50 bp, Homo sapiens
aaaagcatgagtttctgaccagcgttctggacgcgctgtccacggacatg

SEQ ID NO: 219 - DNA, 50 bp, Homo sapiens
atgttcttaggaggcaagccaggagaagccgggtctgacttttcagctca

SEQ ID NO: 220 - DNA, 50 bp, Homo sapiens
tcctccagacccaaagccacaacccatcgcaagtcaagaacactttccag

SEQ ID NO: 221 - DNA, 50 bp, Homo sapiens
accctgggtgggcaaaaacgtgctttcccggacggggttgaaggggagaa

SEQ ID NO: 222 - DNA, 50 bp, Homo sapiens
tggagactgttgccccactctgcagatgcagaaacggaggcttggctgct

SEQ ID NO: 223 - DNA, 50 bp, Homo sapiens
ccagtgtggtatcctgggaaactcggttaaaaggtgaggcagagtaccag

SEQ ID NO: 224 - DNA, 50 bp, Homo sapiens
aaggaagcaggaccagtggatgtgaggcgtggtcgaagaacaacagaaag

SEQ ID NO: 225 - DNA, 50 bp, Homo sapiens
acaggggccagatggtgacccatgacccagcctaaaaggcagccagaggg

SEQ ID NO: 226 - DNA, 50 bp, Homo sapiens
atcagcactgccacctacaccacggtgccgcgcgtggccttctacgccgg

SEQ ID NO: 227 - DNA, 50 bp, Homo sapiens
gtgaaaccccattggcttcattggctccttgatttaaaccacgcccggct

SEQ ID NO: 228 - DNA, 50 bp, Homo sapiens
tgagtccgtgttatatcatctggtctcattgataggcgggatagggaggg

SEQ ID NO: 229 - DNA, 50 bp, Homo sapiens
tttgtggaatagcaacccatggttatggcgagtgacccgacgtgatctgg

SEQ ID NO: 230 - DNA, 50 bp, Homo sapiens
aaggcttaggtgcaaagccattggataccatacctgagaccacacagcca

SEQ ID NO: 231 - DNA, 50 bp, Homo sapiens
accagaagcagctgtccagactccgagacgaaattgaggagaagcagaaa

SEQ ID NO: 232 - DNA, 50 bp, Homo sapiens
gagaagatgaacccgctggaacagtatgagcgaaaggtgaatgcgtctgt

SEQ ID NO: 233 - DNA, 50 bp, Homo sapiens
aactcacagcaagagctgtgttccagttagctttgctaccagttatgcag

SEQ ID NO: 234 - DNA, 50 bp, Homo sapiens
catttccactacgagaacgttgactttggccacattcagctcctgctgtc

SEQ ID NO: 235 - DNA, 50 bp, Homo sapiens
gctgcaatctaagtttcggaatacttataccactccagaaataatcctcg

SEQ ID NO: 236 - DNA, 50 bp, Homo sapiens
ttcagaactgttaacatcgctgacgggaagtggcatcgggtagcaatcag

SEQ ID NO: 237 - DNA, 50 bp, Homo sapiens
acaagatccccgtgaagtacctggagttcatctcggaatgcatcatccag

SEQ ID NO: 238 - DNA, 50 bp, Homo sapiens
taaacaatcaaagagcatgttggcctggtcctttgctaggtactgtagag

SEQ ID NO: 239 - DNA, 50 bp, Homo sapiens
tgcctcgccacaatggcacctgccctaaaatagcttcccatgtgagggct

SEQ ID NO: 240 - DNA, 50 bp, Homo sapiens
caagaggggtttggctgagactttaggattgtgattcagcttagagggac

SEQ ID NO: 241 - DNA, 50 bp, Homo sapiens
cctggtgggagcccatgagaagcgagttctctgtgcaacggacttagtaa

SEQ ID NO: 242 - DNA, 50 bp, Homo sapiens
gctccctggagcatcagcatcatattctggggtggagtctatctggttct

SEQ ID NO: 243 - DNA, 50 bp, Homo sapiens
tcctgcctgtcacctgaagttctagatcattccctggactccactctatc

SEQ ID NO: 244 - DNA, 50 bp, Homo sapiens
tttaacacaggattgggacaggattcagagggacactgtggcccttctac

SEQ ID NO: 245 - DNA, 50 bp, Homo sapiens
tatgtggaggtggtgaacatggacgctgcagtgcagcagcagatgctgaa

SEQ ID NO: 246 - DNA, 50 bp, Homo sapiens
aactctggcaccttgggctgtggaaggctctggaaagtccttcaaagctg

SEQ ID NO: 247 - DNA, 50 bp, Homo sapiens
atgagagtaacctcacccgtgcactagtttacagagcattcactgcccca

SEQ ID NO: 248 - DNA, 50 bp, Homo sapiens
cagagatgagagcctggagcattgcagatgccagggacttcacaaatgaa

SEQ ID NO: 249 - DNA, 50 bp, Homo sapiens
ctcaaaatgaaactccctctcgcagagcacaattccaattcgctctaaaa

SEQ ID NO: 250 - DNA, 50 bp, Homo sapiens
ccgcgttgcttctagaggctgaatgcctttcaaatggagaaggcttccat

SEQ ID NO: 251 - protein, 51 aa, Artificial
  Synthetic peptide
ALGVRQLVGGGHSSRFSHLVVAGLPHACHRKSGSSSQVLCPEPSALLSVAG

SEQ ID NO: 252 - protein, 24 aa, Artificial
  Synthetic peptide
ELGFPSSTGRDESLEHCRCQGLHK

SEQ ID NO: 253 - protein, 11 aa, Artificial
  Synthetic peptide
TTGVSTPAPGV

SEQ ID NO: 254 - protein, 15 aa, Artificial
  Synthetic peptide
VRPCLPVPLLLCWPL

SEQ ID NO: 255 - protein, 11 aa, Artificial
  Synthetic peptide
TTGVSTPAPGV

SEQ ID NO: 256 - protein, 25 aa, Artificial
  Synthetic peptide
VSMMIINSQTIMVVNYSSSFITLML

SEQ ID NO: 257 - protein, 15 aa, Artificial
  Synthetic peptide
MCCNLSFGILIPLQK

SEQ ID NO: 258 - protein, 42 aa, Artificial
  Synthetic peptide
VSFSFSLFYKKVIKFACDKRFVGRHDERKVVKLSLPLYLIYE

SEQ ID NO: 259 - protein, 13 aa, Artificial
  Synthetic peptide
VRSTRPEKVFVFQ

SEQ ID NO: 260 - protein, 18 aa, Artificial
  Synthetic peptide
CYKIEITMPKRRKVKLRD

SEQ ID NO: 261 - protein, 6 aa, Artificial
  Synthetic peptide
VFLNFS

SEQ ID NO: 262 - protein, 8 aa, Artificial
  Synthetic peptide
VSIFYVFI

SEQ ID NO: 263 - protein, 5 aa, Artificial
  Synthetic peptide
GKAGV

SEQ ID NO: 264 - protein, 31 aa, Artificial
  Synthetic peptide
PGLERGADKFPVVGGSSLFLALDLTLRPPVG

SEQ ID NO: 265 - protein, 17 aa, Artificial
  Synthetic peptide
VWAATGRRVARVGMLSL

SEQ ID NO: 266 - protein, 12 aa, Artificial
  Synthetic peptide
LWTSLLALTIPS

SEQ ID NO: 267 - protein, 17 aa, Artificial
  Synthetic peptide
VWAATGRRVARVGMLSL

SEQ ID NO: 268 - protein, 37 aa, Artificial
  Synthetic peptide
LASFSHMSDQRSARPQAGQPHGVVLPGRDCEIPLPPV

SEQ ID NO: 269 - protein, 18 aa, Artificial
  Synthetic peptide
NLLKAQCTSTVPRGIPPS

SEQ ID NO: 270 - protein, 5 aa, Artificial
  Synthetic peptide
PHWRH

SEQ ID NO: 271 - protein, 21 aa, Artificial
  Synthetic peptide
KRSRSVAQAGVQWCDHDSPQP

SEQ ID NO: 272 - protein, 24 aa, Artificial
  Synthetic peptide
FWGMSQNSKEWLKCSRTAWTLILM

SEQ ID NO: 273 - protein, 42 aa, Artificial
  Synthetic peptide
HTREGTLGGQKRAFPDGVEGEKGRGRAWGAASRGSAVPLTIR

SEQ ID NO: 274 - protein, 30 aa, Artificial
  Synthetic peptide
GSSGRHHKQLYVQPPLPQVQFPQGHLWRHG

SEQ ID NO: 275 - protein, 124 aa, Artificial
  Synthetic peptide
GCCLSPSHYRPHSTAISPHPPGSSGRHHKQLYVQPPLPQVQFPQGHLWRHGLCWQCPRREGCLLRECPCHHSQPRKASCVPVPYLTLMPTPGGGDCCPTLQMQKRRLGCCQGEEEDVHPVYPAP

SEQ ID NO: 276 - protein, 42 aa, Artificial; identical to SEQ ID NO: 273
  Synthetic peptide

SEQ ID NO: 277 - protein, 20 aa, Artificial
  Synthetic peptide
VSVPATTPSPGKHPVSLCLI

SEQ ID NO: 278 - protein, 5 aa, Artificial
  Synthetic peptide
DKRTQ

SEQ ID NO: 279 - protein, 8 aa, Artificial
  Synthetic peptide
GKQGMRAH

SEQ ID NO: 280 - DNA, 853 bp, Artificial
  Synthetic oligonucleotide
gtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 281 - DNA, 162 bp, Artificial
  Synthetic oligonucleotide
ggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagag

SEQ ID NO: 282 - DNA, 130 bp, Artificial
  Synthetic oligonucleotide
caaatttctacgtaagaaggaagaatccagcaagaatatccaacagtcaaatcacttgcccaaatatgaacgggtcaaagaactatgccagcaggccaggtaccagacagcctgtgaacaaccggggcag

SEQ ID NO: 283 - DNA, 217 bp, Artificial
  Synthetic oligonucleotide
aagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaa

SEQ ID NO: 284 - DNA, 256 bp, Artificial
  Synthetic oligonucleotide
agtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaa

SEQ ID NO: 285 - DNA, 176 bp, Artificial
  Synthetic oligonucleotide
ggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacc

SEQ ID NO: 286 - DNA, 143 bp, Artificial
  Synthetic oligonucleotide
tgggatctttctgtgcttgcacgagttctaacaataacacctactggtgtttgcgtacagttaatgagacgcataattttcttttctgtgagtttgctactggctttttggagtattttgatatgaatacagatccttatcag

SEQ ID NO: 287 - DNA, 124 bp, Artificial
  Synthetic oligonucleotide
ctcacaaatacagtgcacacggtagaacgaggcattttgaatcagctacacgtacaactaatggagctcagaagctgtcaaggatataagcagtgcaacccaagacctaagaatcttgatgttg

SEQ ID NO: 288 - DNA, 588 bp, Artificial
  Synthetic oligonucleotide
aggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaag

SEQ ID NO: 289 - DNA, 585 bp, Artificial
  Synthetic oligonucleotide
aacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaa

SEQ ID NO: 290 - DNA, 1188 bp, Artificial
  Synthetic oligonucleotide
ttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctg

SEQ ID NO: 291 - DNA, 45 bp, Artificial
  Synthetic oligonucleotide
gaccctatctgcagatgttctgaatacctctgagaatagagattg

SEQ ID NO: 292 - DNA, 28 bp, Artificial
  Synthetic oligonucleotide
attattcaaccaggatacctaattcaag

SEQ ID NO: 293 - DNA, 15 bp, Artificial
  Synthetic oligonucleotide
aacatccgacccaac

SEQ ID NO: 294 - DNA, 40 bp, Artificial
  Synthetic oligonucleotide
attattcttgtgcttaccgatgatcaagatgtggagctgg

SEQ ID NO: 295 - DNA, 74 bp, Artificial
  Synthetic oligonucleotide
gactacttcacagacttaatcactaacgagagcattaattacttcaaaatgtctaagagaatgtatccccatag

SEQ ID NO: 296 - DNA, 96 bp, Artificial
  Synthetic oligonucleotide
gcccgttatgatggtgatcagccacgctgcgccccacggccccgaggactcagccccacagttttctaaactgtaccccaatgcttcccaacacat

SEQ ID NO: 297 - DNA, 59 bp, Artificial
  Synthetic oligonucleotide
aactcctagttataactatgcaccaaatatggataaacactggattatgcagtacacag

SEQ ID NO: 298 - DNA, 92 bp, Artificial
  Synthetic oligonucleotide
gaccaatgctgcccatccacatggaatttacaaacattctacagcgcaaaaggctccagactttgatgtcagtggatgattctgtggagagg

SEQ ID NO: 299 - DNA, 57 bp, Artificial
  Synthetic oligonucleotide
gtttcgaacaaacaagaaggccaaaatttggcgtgatacattcctagtggaaagagg

SEQ ID NO: 300 - DNA, 97 bp, Artificial
  Synthetic oligonucleotide
gtgttttattcttcccaatgactctatccattgtgagagagaactgtaccaatcggccagagcgtggaaggaccataaggcatacattgacaaagag

SEQ ID NO: 301 - DNA, 95 bp, Artificial
  Synthetic oligonucleotide
attgaagctctgcaagataaaattaagaatttaagagaagtgagaggacatctgaagagaaggaagcctgaggaatgtagctgcagtaaacaaag

SEQ ID NO: 302 - DNA, 66 bp, Artificial
  Synthetic oligonucleotide
ctattacaataaagagaaaggtgtaaaaaagcaagagaaattaaagagccatcttcacccattcaa

SEQ ID NO: 303 - DNA, 34 bp, Artificial
  Synthetic oligonucleotide
gaaataaagatggaggaagctatgacctacacag

SEQ ID NO: 304 - DNA, 53 bp, Artificial
  Synthetic oligonucleotide
cttgacacccctggtaaatctttcaacacacttccactgcctgcgtaatgaag

SEQ ID NO: 305 - DNA, 95 bp, Artificial
  Synthetic oligonucleotide
gtgctgacggccacccaccatcatctaaagaagataaacttggcaaatgacatgcaggttcttcaaggcagaataattgcagaaaatcttcaaag

SEQ ID NO: 306 - DNA, 265 bp, Artificial
  Synthetic oligonucleotide
gtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccag

SEQ ID NO: 307 - DNA, 240 bp, Artificial
  Synthetic oligonucleotide
gtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcag

SEQ ID NO: 308 - DNA, 900 bp, Artificial
  Synthetic oligonucleotide
acccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacag

SEQ ID NO: 309 - DNA, 471 bp, Artificial
  Synthetic oligonucleotide
gcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacag

SEQ ID NO: 310 - DNA, 171 bp, Artificial
  Synthetic oligonucleotide
cagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgg

SEQ ID NO: 311 - DNA, 174 bp, Artificial
  Synthetic oligonucleotide
gacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 312 - DNA, 55 bp, Artificial
  Synthetic oligonucleotide
gtccggacaggccgagatgacgccgagccccctgttgctgctcctgctgccgccg

SEQ ID NO: 313 - DNA, 40 bp, Artificial
  Synthetic oligonucleotide
ctgctgctgggggccttcccgccggccgccgccgcccgag

SEQ ID NO: 314 - DNA, 25 bp, Artificial
  Synthetic oligonucleotide
gtcaactacaccctcgtcgtgctgg

SEQ ID NO: 315 - DNA, 51 bp, Artificial
  Synthetic oligonucleotide
atgacattagcccagggaaggagagcctggggcccgacagctcctctgggg

SEQ ID NO: 316 - DNA, 30 bp, Artificial
  Synthetic oligonucleotide
gtcaagaggaccccgccagccagcagtggg

SEQ ID NO: 317 - DNA, 89 bp, Artificial
  Synthetic oligonucleotide
agcggacccgttccaagcccgtgctcacaggcacgcaccccgtgaacacgacggtggacttcggggggaccacgtccttccagtgcaag

SEQ ID NO: 318 - DNA, 78 bp, Artificial
  Synthetic oligonucleotide
atatgctgcctggacacacagataatgctgccttgacacacacatgcacggatattgcctggacacacacacacacac

SEQ ID NO: 319 - DNA, 90 bp, Artificial
  Synthetic oligonucleotide
gcgtgcacagatatgctgtctggacacgcacacacatgcagatatgctgcctggacacacacttccagacacacgtgcacaggcgcagat

SEQ ID NO: 320 - DNA, 46 bp, Artificial
  Synthetic oligonucleotide
atgctgcctggacacacgcagatatgctgtctagtcacacacacac

SEQ ID NO: 321 - DNA, 27 bp, Artificial
  Synthetic oligonucleotide
gcagacatgctgtccggacacacacac

SEQ ID NO: 322 - DNA, 29 bp, Artificial
  Synthetic oligonucleotide
gcatgcacagatatgctgtccggacacac

SEQ ID NO: 323 - DNA, 8 bp, Artificial
  Synthetic oligonucleotide
acacgcac

SEQ ID NO: 324 - protein, 584 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPGARLPRHATPCWCPDPPPGPGVPPTGWGPTLPSRAVLARSSAEGGQPRGTVSTAPGMGLGCSPGLCVGVPLPTSFPLALADPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 325 - protein, 490 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKTQNRQGHLWPPRPRPLACRGPWSSASQPALSSSWAPCSCGFARPRRSRAPPRLPLPCLGTARRGRPATAAETRTFPRWPPSALALVWGCVRSMGLRQPPSTYWAQAQLLALSCTPNSTQTSTHTHTHTLTHTHTWRARSTSTSTISARRHRICSGHGGAGQTGRLGGWRTELQTKAGDPWRGGMASTPGSLCVRHSPWTHTHRHTHYLDACMHTHARTRAP

SEQ ID NO: 326 - DNA, 19 bp, Artificial
  Synthetic oligonucleotide
atttgggtcgcggttcttg

SEQ ID NO: 327 - DNA, 21 bp, Artificial
  Synthetic oligonucleotide
tgccttgacattctcgatggt

SEQ ID NO: 328 - DNA, 133 bp, Artificial
  Synthetic oligonucleotide
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 329 - DNA, 20 bp, Artificial
  Synthetic oligonucleotide
tgggaacaagagggcatctg

SEQ ID NO: 330 - DNA, 22 bp, Artificial
  Synthetic oligonucleotide
ccaccactgcatcaaattcatg

SEQ ID NO: 331 - DNA, 86 bp, Artificial
  Synthetic oligonucleotide
tgggaacaagagggcatctgctaaagtttcagattccatttctgctcagtatccagtagtggatcatgaatttgatgcagtggtgg

SEQ ID NO: 332 - DNA, 19 bp, Artificial
  Synthetic oligonucleotide
tgagagtgattcgcgtggg

SEQ ID NO: 333 - DNA, 21 bp, Artificial
  Synthetic oligonucleotide
ccagggtacgaggctttcaat

SEQ ID NO: 334 - DNA, 91 bp, Artificial
  Synthetic oligonucleotide
tgagagtgattcgcgtgggtacccgcaagagccagcttgctcgcatacagacggacagtgtggtggcaacattgaaagcctcgtaccctgg

SEQ ID NO: 335 - DNA, 760 bp, Artificial
  Synthetic oligonucleotide
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtgg

SEQ ID NO: 336 - DNA, 224 bp, Artificial
  Synthetic oligonucleotide
ggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagat

SEQ ID NO: 337 - DNA, 359 bp, Artificial
  Synthetic oligonucleotide
gttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 338 - DNA, 19 bp, Artificial
  Synthetic oligonucleotide
gtaggttcaaaaggcaaag

SEQ ID NO: 339 - DNA, 14 bp, Artificial
  Synthetic oligonucleotide
actctctgctccag

SEQ ID NO: 340 - DNA, 178 bp, Artificial
  Synthetic oligonucleotide
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcag

SEQ ID NO: 341 - DNA, 780 bp, Artificial
  Synthetic oligonucleotide
ttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 342 - DNA, 93 bp, Artificial
  Synthetic oligonucleotide
gcacggtggctcacgcctgtaatcccagcactttgggaggccgagacgggcggatcacgaggtcaagagatggagaccatcccggctaacacg

SEQ ID NO: 343 - DNA, 6 bp, Artificial
  Synthetic oligonucleotide
attcag

SEQ ID NO: 344 - DNA, 56 bp, Artificial
  Synthetic oligonucleotide
aagaggaaatgaaagcattagaagcagatttcttgaccaatatgcatacatcaaag

SEQ ID NO: 345 - DNA, 115 bp, Artificial
  Synthetic oligonucleotide
attagtaaagcacatgttccctcttggaagatgactctgctaaatgtttgcagtcttgtaaataatttgaacagcccagctgaggaaacaggagaagttcatgaagaggagcttg

SEQ ID NO: 346 - DNA, 34 bp, Artificial
  Synthetic oligonucleotide
ttgcaagaaggaaacttcctactgctttagatgg

SEQ ID NO: 347 - DNA, 26 bp, Artificial
  Synthetic oligonucleotide
ctttagcttggaagcaatgttgacaa

SEQ ID NO: 348 - DNA, 8 bp, Artificial
  Synthetic oligonucleotide
tataccag

SEQ ID NO: 349 - DNA, 42 bp, Artificial
  Synthetic oligonucleotide
ctccacaaaatctgtcacagcagggcttttcaacactgggag

SEQ ID NO: 350 - DNA, 245 bp, Artificial
  Synthetic oligonucleotide
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcag

SEQ ID NO: 351 - DNA, 161 bp, Artificial
  Synthetic oligonucleotide
cttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgt

SEQ ID NO: 352 - DNA, 121 bp, Artificial
  Synthetic oligonucleotide
ccatggtacaaggaatagtcgcgcaagcatcccgctggtgcctcccgggacgaaggacttcccgagcggtgtggggaccgggctctgacagccctgcggagaccctgagtccgggaggcac

SEQ ID NO: 353 - DNA, 631 bp, Artificial
  Synthetic oligonucleotide
cgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 354 - DNA, 150 bp, Artificial
  Synthetic oligonucleotide
gtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccag

SEQ ID NO: 355 - DNA, 233 bp, Artificial
  Synthetic oligonucleotide
gtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcag

SEQ ID NO: 356 - DNA, 76 bp, Artificial
  Synthetic oligonucleotide
cttctaagccacaagcacacggggctccagcccccccgagtggaagtgctccccactttctttaggatttaggcgc

SEQ ID NO: 357 - DNA, 119 bp, Artificial
  Synthetic oligonucleotide
ggtctgcgcttcgcagccgggatgaagctggtttccgtcgccctgatgtacctgggttcgctcgccttcctaggcgctgacaccgctcggttggatgtcgcgtcggagtttcgaaagaa

SEQ ID NO: 358 - DNA, 59 bp, Artificial
  Synthetic oligonucleotide
gtggaataagtgggctctgagtcgtgggaagagggaactgcggatgtccagcagctacc

SEQ ID NO: 359 - DNA, 40 bp, Artificial
  Synthetic oligonucleotide
ccaccgggctcgctgacgtgaaggccgggcctgcccagac

SEQ ID NO: 360 - DNA, 51 bp, Artificial
  Synthetic oligonucleotide
ccttattcggccccaggacatgaagggtgcctctcgaagccccgaagacag

SEQ ID NO: 361 - DNA, 84 bp, Artificial
  Synthetic oligonucleotide
cagtccggatgccgcccgcatccgagtcaagcgctaccgccagagcatgaacaacttccagggcctccggagctttggctgccg

SEQ ID NO: 362 - DNA, 573 bp, Artificial
  Synthetic oligonucleotide
ttatgctcccgcggaggccaagcggactccctgacaggacagaatctgaacgtgagagtgaaggtcttgcctgtccagaaactcttgtagccagcacaggtttaaacaagaagccaaattgttctggagagattgctgggggctttctttgtgcctcaagcttcttcagtgccctgagcacaggaaacactcaagcagagaagcagagccaaacccaggatacgggaggtcgaggctcttccgtagacctgcagcattggggtgggatgatgttcattctgtgtgtgttctggaccaagcccctctccagggacctatgggcagccccctttaagcaagatgcccggtggagtgggcatccaccatcacttaccctgggcttgggtgaatagattttccgtgccttaaatgggcagggagggggtaaacatggacggtccattggtacaaataaaagcctttggtgggttttgatcaattgcaaggatcgaaggagacctgtggacctgaggtcaactggcagcagagaagagtctgggttcgtgaaggcgccgccgcggtgccgcgccacgt

SEQ ID NO: 363 - DNA, 387 bp, Artificial
  Synthetic oligonucleotide
gtaagccttccctcttgcttccccactccctgctgggctgagacgctcccaggagatcccgcccctgccacgcatcccagtgcatccctgcttggggtgccagtagcgggaagggcagaagttctgcctgacctggtctgtcatcacaacaagcctgtatcaaatttgaggcacccctcccacgccgcccaagtctcgcgcattctcctcccgagttgtaccagctatacttaagggcagtttaaaaataaaacaaacaaacaaaaacaacaaaactaaaaaaacgaagaactgaacggcggtttaaaaaaaaatagatacacgattattgttaaagatgctagcactggagctgcgcagagcgttggaagtggtgtttggtggagg

SEQ ID NO: 364 - DNA, 249 bp, Artificial
  Synthetic oligonucleotide
atttgcataaaaaaggccaagaaaactctggctgtgccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctcc

SEQ ID NO: 365 - DNA, 10 bp, Artificial
  Synthetic oligonucleotide
gtgctggagc

SEQ ID NO: 366 - DNA, 35 bp, Artificial
  Synthetic oligonucleotide
aggccggcgcttggatcccgctggtcatgaagcag

SEQ ID NO: 367 - DNA, 21 bp, Artificial
  Synthetic oligonucleotide
tgccacccggacaccaagaag

SEQ ID NO: 368 - DNA, 92 bp, Artificial
  Synthetic oligonucleotide
ttcctgtgctcgctcttcgcccccgtctgcctcgatgacctagacgagaccatccagccatgccactcgctctgcgtgcaggtgaaggaccg

SEQ ID NO: 369 - protein, 25 aa, Artificial
  Synthetic peptide
GEKRHHKQLRDQEVDPLEMRRHSAG

SEQ ID NO: 370 - DNA, 60 bp, Artificial
  Synthetic oligonucleotide
ctgcgccccggtcatgtccgccttcggcttcccctggcccgacatgcttgagtgcgaccg

SEQ ID NO: 371 - DNA, 71 bp, Artificial
  Synthetic oligonucleotide
tttcccccaggacaacgacctttgcatccccctcgctagcagcgaccacctcctgccagccaccgaggaag

SEQ ID NO: 372 - DNA, 70 bp, Artificial
  Synthetic oligonucleotide
gctccctctgccccctcggggtcgcgcgcccacgatgctgcagggccctggctcgctgctgctgctcttc

SEQ ID NO: 373 - DNA, 11 bp, Artificial
  Synthetic oligonucleotide
ctcgcctcgca

SEQ ID NO: 374 - DNA, 24 bp, Artificial
  Synthetic oligonucleotide
ctgctgcctgggctcggcgcgcgg

SEQ ID NO: 375 - DNA, 7 bp, Artificial
  Synthetic oligonucleotide
gctcttc

SEQ ID NO: 376 - DNA, 80 bp, Artificial
  Synthetic oligonucleotide
ctctttggccagcccgacttctcctacaagcgcagcaattgcaagcccatcccggccaacctgcagctgtgccacggcat

SEQ ID NO: 377 - DNA, 55 bp, Artificial
  Synthetic oligonucleotide
cgaataccagaacatgcggctgcccaacctgctgggccacgagaccatgaaggag

SEQ ID NO: 378 - DNA, 213 bp, Artificial
  Synthetic oligonucleotide
gactgggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaag

SEQ ID NO: 379 - DNA, 432 bp, Artificial
  Synthetic oligonucleotide
gtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcag

SEQ ID NO: 380 - DNA, 159 bp, Artificial
  Synthetic oligonucleotide
gtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcag

SEQ ID NO: 381 - DNA, 139 bp, Artificial
  Synthetic oligonucleotide
ggttatgtattaagctctattgaaggccgagtggcagttgagtatttggacccaagccctgaggtacagaagaagaagtatgccttcaaatgtcacagactaaaagaaaataatattgagcagatttacccagtcaatg

SEQ ID NO: 382 - DNA, 196 bp, Artificial
  Synthetic oligonucleotide
atatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaa

SEQ ID NO: 383 - DNA, 353 bp, Artificial
  Synthetic oligonucleotide
gtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaaga

SEQ ID NO: 384 - DNA, 590 bp, Artificial
  Synthetic oligonucleotide
tattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtag

SEQ ID NO: 385 - DNA, 1228 bp, Artificial
  Synthetic oligonucleotide
gtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtcttttttttttttaagtatttcagtgaaaacttggtgtaagtctgaacccatcttttgaaatgtattttcttcattgcag

SEQ ID NO: 386 - DNA, 326 bp, Artificial
  Synthetic oligonucleotide
gtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaatgga

SEQ ID NO: 387 - DNA, 70 bp, Artificial
  Synthetic oligonucleotide
gatccaacgcatgcctggagtggaggactagatcatcaattgaaaatgcatgatttgaacactgatcaag

SEQ ID NO: 388 - DNA, 39 bp, Artificial
  Synthetic oligonucleotide
aaaatcttgttgggacccatgatgcccctatcagatgtg

SEQ ID NO: 389 - DNA, 79 bp, Artificial
  Synthetic oligonucleotide
ttgaatactgtccagaagtgaatgtgatggtcactggaagttgggatcagacagttaaactgtgggatcccagaactcc

SEQ ID NO: 390 - DNA, 34 bp, Artificial
  Synthetic oligonucleotide
ttgtaatgctgggaccttctctcagcctgaaaag

SEQ ID NO: 391 - DNA, 33 bp, Artificial
  Synthetic oligonucleotide
atgaccggttctaacgagttcaagctgaaccag

SEQ ID NO: 392 - DNA, 39 bp, Artificial
  Synthetic oligonucleotide
ccatttcttttcacaatatccacaatacatttgccacag

SEQ ID NO: 393 - DNA, 21 bp, Artificial
  Synthetic oligonucleotide
gtggttctgatggctttgtaa

SEQ ID NO: 394 - DNA, 48 bp, Artificial
  Synthetic oligonucleotide
atttgaactgccaaaaatctttcctctccacagaggttgtttctttaa

SEQ ID NO: 395 - DNA, 38 bp, Artificial
  Synthetic oligonucleotide
ccacccgaggatggcatctcctccgtgaagttcagccc

SEQ ID NO: 396 - DNA, 111 bp, Artificial
  Synthetic oligonucleotide
caacacctcccagttcctgcttgtctcctcctgggacacgtccgtgcgtctctacgatgtgccggccaactccatgcggctcaagtaccagcacaccggcgccgtcctgga

SEQ ID NO: 397 - DNA, 13 bp, Artificial
  Synthetic oligonucleotide
ctgcgccttctac

SEQ ID NO: 398 - DNA, 257 bp, Artificial
  Synthetic oligonucleotide
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcg

SEQ ID NO: 399 - DNA, 133 bp, Artificial
  Synthetic oligonucleotide
ctggtcctgccgctgctgtgttgagagagctgcgttgcgtttgtttacagaccacgcagggagttcatcccaaaatgatcagtaatctgcaagtgttcgccataggcccacagtgctccaaggtggaagtggt

SEQ ID NO: 400 - DNA, 1786 bp, Artificial
  Synthetic oligonucleotide
tggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtat

SEQ ID NO: 401 - DNA, 153 bp, Artificial
  Synthetic oligonucleotide
atataatatatattatatatttagcattgctgagctttttagatgcctattgtgtatcttttaaaggttttgaccattttgttatgagtaattacatatatattacattcactatattaaaattgtacttttttactatgtgtctcattggtt

SEQ ID NO: 402 - DNA, 110 bp, Artificial
  Synthetic oligonucleotide
gtaagttctgtgctgctgtgtccgctgtgaccttggcaagagagaaatcccgcagcctgggtcttcaaccttggtatctcatgagtgtatcttctttttctttccttcag

SEQ ID NO: 403 - DNA, 84 bp, Artificial
  Synthetic oligonucleotide
agcctccctgaagaacgggaaggaaatttgtcttgatccagaagccccttttctaaagaaagtcatccagaaaattttggacgg

SEQ ID NO: 404 - DNA, 23 bp, Artificial
  Synthetic oligonucleotide
gtatttatatattatatatttat

SEQ ID NO: 405 - DNA, 139 bp, Artificial
  Synthetic oligonucleotide
gtgcgtctccatggcgacccgccggtgctataagtagggagcggcgtgccgtggggctttgtcagtccctcctgtagccgccgccgccgccgcccgccgcccctctgccagcagctccggcgccacctcgggccggcgt

SEQ ID NO: 406 - DNA, 135 bp, Artificial
  Synthetic oligonucleotide
gttggttttgcggattgccactgatgattccaaagcagtctgtcgtctcagtgtgaaattcggtgccacgctcagaaccagcaggctccttttggaacgggcgaaagagctaaatatcgatgttgttggtgtcag

SEQ ID NO: 407 - DNA, 163 bp, Artificial
  Synthetic oligonucleotide
atcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatg

SEQ ID NO: 408 - DNA, 215 bp, Artificial
  Synthetic oligonucleotide
agacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtg

SEQ ID NO: 409 - DNA, 173 bp, Artificial
  Synthetic oligonucleotide
gatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagtt

SEQ ID NO: 410 - DNA, 1096 bp, Artificial
  Synthetic oligonucleotide
ttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggcattgggacgtttttatggtgtgttcattccagacagttcacgaatcccgtatagctcgctctgattctcagagaacaatgagtgggtccacccacacacaggtaggaggacaggtgagacggaagccccatcctcccatgtggacggtgcacatctgctcagcccaccccacatgtccagagttggctgcaaactccttgtccagagcctctggtggtgggacctacttaagtctgacggacctgtcctgtccaggccagtgcccagggaaggtgtgggaggccctttgagcctggcctgcagagaccatccgtgtcccctcccaccttcatgcctgtgagaagttaggaatgtatacggtaccacatttggcagtcagcttattttaataaattcagcaacagcaagtccctaccatgttgtgtatcttcaccatcttgtctgaccatgaccactggccttgtgtgttcttttactcaacgtgtacccccgctctcccccaaagtgtggcaggctctcatgctccttaacccccattgtggcaatgtcttacgggtaacgctggagctgcaggaggagggaaggacacgtcagagccaccaggcagtgggagcatcttggagtccccaccagcctcatgagggggacaggaagagagcaaatgtgtagggaggaaggctgtggctcctcccggggtgggaaggtcaagccgatgctgtcacccatttaccaaagctgaagagagtgacttcctttctcaaaagcatcaccttcccctgaaccctgagtccagagaagccaggagccctcatgtggctgccgagttagctcagggcttggcttatcaccaactctggtctccctgggccagggttgccaaaacatgaaagattttttcaggagccagaggttggttctgactggaggggga

SEQ ID NO: 411 - DNA, 117 bp, Artificial
  Synthetic oligonucleotide
gacgtcggcccgccggcgccccaccagctccgcgcgggcccgggttggccaccgccgggcccccgcccctcccccggcggtgtcccggccggaaccgatcgtggctggtttgagctg

SEQ ID NO: 412 - DNA, 110 bp, Artificial
  Synthetic oligonucleotide
attgtcactgctgttccaagggcacacgcagagggatttggaattcctggagagttgcctttgtgagaagctggaaatatttctttcaattccatctcttagttttccat

SEQ ID NO: 413 - DNA, 92 bp, Artificial
  Synthetic oligonucleotide
aggaacatcaagaaatcatgaacaactttggtaatgaagagtttgactgccacttcctcgatgaaggttttactgccaaggacattctggac

SEQ ID NO: 414 - DNA, 27 bp, Artificial
  Synthetic oligonucleotide
cagaaaattaatgaagtttcttcttct

SEQ ID NO: 415 - DNA, 72 bp, Artificial
  Synthetic oligonucleotide
ctccggcgggcgggagccaggcgctgacgggcgcggcgggggcggccgagcgctcctgcggctgcgactcag

SEQ ID NO: 416 - DNA, 82 bp, Artificial
  Synthetic oligonucleotide
cttccatgtaggaagcggctgtaccgatcctgagaccttcgtgcaggcaatctctgatgcccgctgtgtttttgacatgggg

SEQ ID NO: 417 - DNA, 56 bp, Artificial
  Synthetic oligonucleotide
gctccggcgtctgcgcttccccatggggctggcctgcggcgcctgggcgctctgag

SEQ ID NO: 418 - DNA, 84 bp, Artificial
  Synthetic oligonucleotide
gctgaggttggtttcagcatgtatctgcttgatattggcggtggctttcctggatctgaggatgtgaaacttaaatttgaagag

SEQ ID NO: 419 - DNA, 113 bp, Artificial
  Synthetic oligonucleotide
acgaagatgagtcgagtgagcagacctttatgtattatgtgaatgatggcgtctatggatcatttaattgcatactctatgaccacgcacatgtaaagccccttctgcaaaag

SEQ ID NO: 420 - DNA, 55 bp, Artificial
  Synthetic oligonucleotide
gcaactcatgcagcaattccagaaccccgacttcccacccgaagtagaggaacag

SEQ ID NO: 421 - DNA, 94 bp, Artificial
  Synthetic oligonucleotide
ttgaaatgtctttgtaagagtagggtcgccatgatgcagccatatggaagactaggatatgggtcacacttatctgtgttcctatggaaactat

SEQ ID NO: 422 - DNA, 271 bp, Artificial
  Synthetic oligonucleotide
gcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccag

SEQ ID NO: 423 - DNA, 172 bp, Artificial
  Synthetic oligonucleotide
gggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccg

SEQ ID NO: 424 - DNA, 77 bp, Artificial
  Synthetic oligonucleotide
gagaacttcaacaatgtcccggacctggagctcaaccccatccgatccaaaattgttcgtgccttcttcgacaacag

SEQ ID NO: 425 - DNA, 115 bp, Artificial
  Synthetic oligonucleotide
gaacctgcgcaagggacccagtggcctggctgatgagatcaatttcgaggacttcctgaccatcatgtcctacttccggcccatcgacaccaccatggacgaggaacaggtggag

SEQ ID NO: 426 - DNA, 25 bp, Artificial
  Synthetic oligonucleotide
ctgtcccggaaggagaagctgagat

SEQ ID NO: 427 - DNA, 62 bp, Artificial
  Synthetic oligonucleotide
ttctgttccacatgtacgactcggacagcgacggccgcatcactctggaagaatatcgaaat

SEQ ID NO: 428 - DNA, 108 bp, Artificial
  Synthetic oligonucleotide
gtggtcgaggagctgctgtcgggaaaccctcacatcgagaaggagtccgctcgctccatcgccgacggggccatgatggaggcggccagcgtgtgcatggggcagatg

SEQ ID NO: 429 - DNA, 48 bp, Artificial
  Synthetic oligonucleotide
gagcctgatcaggtgtacgaggggatcaccttcgaggacttcctgaag

SEQ ID NO: 430 - DNA, 9 bp, Artificial
  Synthetic oligonucleotide
atctggcag

SEQ ID NO: 431 - DNA, 108 bp, Artificial
  Synthetic oligonucleotide
gtacatagccaaggctcgtctgcgcaccttgtgtcttgtagggtatggtatgtgggacttcgctgtttttatctccaataaaaaaaaaaaaaaggtttgttaattaat

SEQ ID NO: 432 - DNA, 70 bp, Artificial
  Synthetic oligonucleotide
tctcatcggatcagatcgagcagctccatcggagatttaagcagctgagtggagatcagcctaccattcg

SEQ ID NO: 433 - DNA, 4 bp, Artificial
  Synthetic oligonucleotide
caag

SEQ ID NO: 434 - DNA, 157 bp, Artificial
  Synthetic oligonucleotide
ggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagcc

SEQ ID NO: 435 - DNA, 137 bp, Artificial
  Synthetic oligonucleotide
tacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccag

SEQ ID NO: 436 - DNA, 436 bp, Artificial
  Synthetic oligonucleotide
tctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatc

SEQ ID NO: 437 - DNA, 669 bp, Artificial
  Synthetic oligonucleotide
ggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcct

SEQ ID NO: 438 - DNA, 33 bp, Artificial
  Synthetic oligonucleotide
ggtgactccgggggccctctggtctgtaaccag

SEQ ID NO: 439 - DNA, 75 bp, Artificial
  Synthetic oligonucleotide
aggaacctggggcccgctcctcccccctccaggccatgaggattctgcagttaatcctgcttgctctggcaacag

SEQ ID NO: 440 - DNA, 616 bp, Artificial
  Synthetic oligonucleotide
ccttgctgttcatggcccagcaggggccctatgggggtcaggcctgcaggcactcacacttggcacctgctccaaaaccctttcaggtctttgaggatctgagccctgggcctgggtctcccgccggctcggaaaagctggcctgccgggccagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccag

SEQ ID NO: 441 - DNA, 1062 bp, Artificial
  Synthetic oligonucleotide
gtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgccccactccctctgctgcccagaaacctgataaactccttccttcgcaggtgctggaaggcaccacaggtttggctctttaaaatcagagccactgttaaccaaggcgggcagcagtgttaagaccaccagcaccctgaaccagccctgtacttactgggcactgtttccttaaaatcagaaggtggcttcccatctctggtttcctggggtcttatgtctgtcctcggagggagaatccagttcctagctcccctgtaccatgcgaaggtagcctgtcctgtctcactcctcagatacgcagagtctgtttacacatttgcctgcatagcatgatcaggaagcacacacacacacacacacacacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgc

SEQ ID NO: 442 - DNA, 261 bp, Artificial
  Synthetic oligonucleotide
ctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccac

SEQ ID NO: 443 - DNA, 1361 bp, Artificial
  Synthetic oligonucleotide
gccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgcttttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttctggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccag

SEQ ID NO: 444 - DNA, 569 bp, Artificial
  Synthetic oligonucleotide
atgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaac

SEQ ID NO: 445 - DNA, 163 bp, Artificial
  Synthetic oligonucleotide
caatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttat

SEQ ID NO: 446 - DNA, 81 bp, Artificial
  Synthetic oligonucleotide
cagagccggaaggcgcgccccgggcagagaaagccgagcagagctgggtggcgtctccgggccgccgctccgacgggccag

SEQ ID NO: 447 - DNA, 56 bp, Artificial
  Synthetic oligonucleotide
ctgcagagcaccaagcgcttcatcaagtggtacaacgcctggaacgagaagcgcag

SEQ ID NO: 448 - DNA, 17 bp, Artificial
  Synthetic oligonucleotide
actctgtcaccctccag

SEQ ID NO: 449 - DNA, 81 bp, Artificial
  Synthetic oligonucleotide
ggtctacgaagaatagggtgaaaaacctcagaagggaaaactccaaaccagttgggagacttgtgcaaaggactttgcaga

SEQ ID NO: 450 - DNA, 20 bp, Artificial
  Synthetic oligonucleotide
ttaaaaaaaaaaaaaaaaaa

SEQ ID NO: 451 - DNA, 108 bp, Artificial
  Synthetic oligonucleotide
aagcctttctttctcacaggcataagacacaaattatatattgttatgaagcactttttaccaacggtcagtttttacattttatagctgcgtgcgaaaggcttccag

SEQ ID NO: 452 - DNA, 40 bp, Artificial
  Synthetic oligonucleotide
cgccctccccatgtccctgctcccacgccgcgcccctccg

SEQ ID NO: 453 - DNA, 23 bp, Artificial
  Synthetic oligonucleotide
cttaggagaaaacttaaaaatat

SEQ ID NO: 454 - DNA, 53 bp, Artificial
  Synthetic oligonucleotide
atgaatacatgcgcaatacacagctacagacacacattctgttgacaagggaa

SEQ ID NO: 455 - DNA, 54 bp, Artificial
  Synthetic oligonucleotide
aaccttcaaagcatgtttctttccctcaccacaacagaacatgcagtactaaag

SEQ ID NO: 456 - DNA, 103 bp, Artificial
  Synthetic oligonucleotide
atgctatgtacatgtcagaaaccattagcattgcatgcaggtttcatattctttctaagatggaaagtaataaaatatatttgaaatgtaccaaaattctaga

SEQ ID NO: 457 - DNA, 36 bp, Artificial
  Synthetic oligonucleotide
gtcagcatgaggctcctggcggccgcgctgctcctg

SEQ ID NO: 458 - DNA, 34 bp, Artificial
  Synthetic oligonucleotide
ctgctgctggcgctgtacaccgcgcgtgtggacg

SEQ ID NO: 459 - DNA, 106 bp, Artificial
  Synthetic oligonucleotide
ggtccaaatgcaagtgctcccggaagggacccaagatccgctacagcgacgtgaagaagctggaaatgaagccaaagtacccgcactgcgaggagaagatggttat

SEQ ID NO: 460 - DNA, 58 bp, Artificial
  Synthetic oligonucleotide
catcaccaccaagagcgtgtccaggtaccgaggtcaggagcactgcctgcaccccaag

SEQ ID NO: 461 - DNA, 669 bp, Artificial
  Synthetic oligonucleotide
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacg

SEQ ID NO: 462 - DNA, 187 bp, Artificial
  Synthetic oligonucleotide
tgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaag

SEQ ID NO: 463 - DNA, 172 bp, Artificial
  Synthetic oligonucleotide
tttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaag

SEQ ID NO: 464 - DNA, 275 bp, Artificial
  Synthetic oligonucleotide
gctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccaca

SEQ ID NO: 465 - DNA, 1685 bp, Artificial
  Synthetic oligonucleotide
gatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcag

SEQ ID NO: 466 - DNA, 877 bp, Artificial
  Synthetic oligonucleotide
ccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctc

SEQ ID NO: 467 - DNA, 252 bp, Artificial
  Synthetic oligonucleotide
gatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaag

SEQ ID NO: 468 - DNA, 349 bp, Artificial
  Synthetic oligonucleotide
gaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 469 - DNA, 233 bp, Artificial
  Synthetic oligonucleotide
cacctcataatcatgtgaaaaagacactcaaaaactaccatttgaatggatggatgaaaataacctccgtatattctacgaagatgtttaataataaataggtttcgttataagagaatgtgtgtcacttcgtctcttccctcacccccgagacttagtgacagttatttttgacttttccaactatactatttgcctagaaaatgtgtctattaaatagcgtattgagaaat

SEQ ID NO: 470 - DNA, 51 bp, Artificial
  Synthetic oligonucleotide
atgatgccgcagctccagcgttggagactcagcctcaaggagatgaagaag

SEQ ID NO: 471 - DNA, 75 bp, Artificial
  Synthetic oligonucleotide
atattgcatcacgttaccctaccctttggactgaacaggttaaaagtcggcagaacaaaaccaataagaattcag

SEQ ID NO: 472 - DNA, 83 bp, Artificial
  Synthetic oligonucleotide
gtacgagcagccgaaatgtgacaacacggccagggcccacccagccaaagcccgggacctgtacaagggccgccagctacaag

SEQ ID NO: 473 - DNA, 103 bp, Artificial
  Synthetic oligonucleotide
gttgtccgggtgccaaaaagcatgagtttctgaccagcgttctggacgcgctgtccacggacatggtccacgccgcctccgacccctcctcctcgtcaggcag

SEQ ID NO: 474 - DNA, 95 bp, Artificial
  Synthetic oligonucleotide
gaagtaagagaaacctgtgatggccagagcccagatgttcttaggaggcaagccaggagaagccgggtctgacttttcagctcagagacagcact

SEQ ID NO: 475 - DNA, 38 bp, Artificial
  Synthetic oligonucleotide
cccccagaggtcatgctgaaagtacgtctaatagacag

SEQ ID NO: 476 - DNA, 75 bp, Artificial
  Synthetic oligonucleotide
ctgatcctcctacctggtccaccccagggctaccggaaggtaaaatcttcacctgaaccaattatgagcagtctc

SEQ ID NO: 477 - DNA, 19 bp, Artificial
  Synthetic oligonucleotide
cttactgaaggtacagccg

SEQ ID NO: 478 - DNA, 65 bp, Artificial
  Synthetic oligonucleotide
ctactgtggttgagaggaaaggtgtctttttattgcttctagagacgttgaaagtgtgacctgag

SEQ ID NO: 479 - DNA, 107 bp, Artificial
  Synthetic oligonucleotide
acgtgtccaggtgtgtggccgaaaggaagtatacccaggagcaagcccggaaggagtttcagcaagtgttcattcctgagtgcaatgacgacggcacctacagtcag

SEQ ID NO: 480 - DNA, 100 bp, Artificial
  Synthetic oligonucleotide
gtccagtgtcacagctacacgggatactgctggtgcgtcacgcccaacgggaggcccatcagcggcactgccgtggcccacaagacgccccggtgcccgg

SEQ ID NO: 481 - DNA, 48 bp, Artificial
  Synthetic oligonucleotide
gttccgtaaatgaaaagttaccccaacgcgaaggcacaggaaaaacag

SEQ ID NO: 482 - DNA, 170 bp, Artificial
  Synthetic oligonucleotide
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccgg

SEQ ID NO: 483 - DNA, 120 bp, Artificial
  Synthetic oligonucleotide
gcacacacgcgaggggaccctgggtgggcaaaaacgtgctttcccggacggggttgaaggggagaaagggagaggtcgggcttggggggctgcctcccgcggctcagcagttcctctgac

SEQ ID NO: 484 - DNA, 211 bp, Artificial
  Synthetic oligonucleotide
gcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagg

SEQ ID NO: 485 - DNA, 297 bp, Artificial
  Synthetic oligonucleotide
tgctcaccaatgccccaggcatcaggctcctgggctgcctctccatgcctcccacacccaccctagctctggccgattctcctgcagcactgagcccattcctctccccagaaacttccaagccatgctcaaccgcagctcccacggaaacccctctgggggttcctctggtgggcctgccctggcacctgcgtgtcccccaacacacatgccctgaaagaagtgggcccagcatccggaggagccccggcagccccagactgggcgtgttccctgtatcaggaatcccttccctct

SEQ ID NO: 486 - DNA, 225 bp, Artificial
  Synthetic oligonucleotide
gaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccag

SEQ ID NO: 487 - DNA, 362 bp, Artificial
  Synthetic oligonucleotide
ggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 488 - DNA, 515 bp, Artificial
  Synthetic oligonucleotide
ataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagacgccaaggagcaacacacgcaccagggtaggctggagaaaccagaacccgggaatcccgcctccctcaacttgaaacttgggaatagtgtattctcttttcaacacttgcactagtagaaggttaattacatgaaagattaggcaaaatgtatggctatgtgtcctggttttccaataaaagtattgagtttctctggggaaagtgcagataaaatgcttagtggaggctgggcgctgtggcttatgcctgtaatcccagcactttgggaggccgaggcaggcaggcagatcacaaggtcaggagtttgagaccggcctggccaatatgatg

SEQ ID NO: 489 - DNA, 27 bp, Artificial
  Synthetic oligonucleotide
agtcgcaggaggcggcgcccttatcag

SEQ ID NO: 490 - DNA, 8 bp, Artificial
  Synthetic oligonucleotide
catccgag

SEQ ID NO: 491 - DNA, 59 bp, Artificial
  Synthetic oligonucleotide
gaccatgcggccgacgggtcatcacgtcgcgcatcgtgggtggagaggacgccgaactc

SEQ ID NO: 492 - DNA, 42 bp, Artificial
  Synthetic oligonucleotide
gggcgttggccgtggcaggggagcctgcgcctgtgggattcc

SEQ ID NO: 493 - DNA, 65 bp, Artificial
  Synthetic oligonucleotide
cacgtatgcggagtgagcctgctcagccaccgctgggcactcacggcggcgcactgctttgaaac

SEQ ID NO: 494 - DNA, 6 bp, Artificial
  Synthetic oligonucleotide
ctatag

SEQ ID NO: 495 - DNA, 76 bp, Artificial
  Synthetic oligonucleotide
tgaccttagtgatccctccgggtggatggtccagtttggccagctgacttccatgccatccttctggagcctgcag

SEQ ID NO: 496 - DNA, 37 bp, Artificial
  Synthetic oligonucleotide
gttgctgtctctctccttcccactatcgtccgcacag

SEQ ID NO: 497 - DNA, 26 bp, Artificial
  Synthetic oligonucleotide
cactgccatctccccacaccctccag

SEQ ID NO: 498 - DNA, 59 bp, Artificial
  Synthetic oligonucleotide
gaagttcaggtcgccatcataaacaactctatgtgcaaccacctcttcctcaagtacag

SEQ ID NO: 499 - DNA, 28 bp, Artificial
  Synthetic oligonucleotide
tttccgcaaggacatctttggagacatg

SEQ ID NO: 500 - DNA, 42 bp, Artificial
  Synthetic oligonucleotide
gtttgtgctggcaatgcccaaggcgggaaggatgcctgcttc

SEQ ID NO: 501 - DNA, 31 bp, Artificial
  Synthetic oligonucleotide
gtgagtgtccctgccaccactcccagcccag

SEQ ID NO: 502 - DNA, 712 bp, Artificial
  Synthetic oligonucleotide
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccag

SEQ ID NO: 503 - DNA, 302 bp, Artificial
  Synthetic oligonucleotide
cggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatgg

SEQ ID NO: 504 - DNA, 206 bp, Artificial
  Synthetic oligonucleotide
ccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgc

SEQ ID NO: 505 - DNA, 139 bp, Artificial
  Synthetic oligonucleotide
gctaaatggctctctccccaagggtgtggaggcccagaacagaaccctcttcttcaagggacccatcaactacagcctggcagggacctacatctgtgaggccaccaaccccatcggtacacgctcaggccaggtggag

SEQ ID NO: 506 - DNA, 1474 bp, Artificial
  Synthetic oligonucleotide
gtgagggtcacagtctgcccatcagtcctggagttcttcagacccagaattgcgggccttgaaggccagtgtcctggaagggaggcaggtgtgagcctgcaagtgtgcatgcccagccatggtatggacatgtgtctctgggcatgtaaatgtgaaccagtgtgaacaggctccgtctgcatgctgagtgtgcatgtgggagcccgtggctgtgccgtggcaacgtgccattctctgagccagcgaatggcagtgtgttgggaggtctgagaaggcagctgcatccgtgcctctgggaggattcggttctcccccagcttgccgaggccctgcctgatggtctgacacgaggcacagctgctgcagctgcagatggacagaagggcttcccagaggtggaccccaggcctccccactctccctgtggctggctgcactgcatgctggggggtgtagttcttgcagcttccaggcctaatctgatgccggagcatttcctgcctgaggaagcgccaggcattggtttcggaggcaaacccaaacattctctttgaccccaaacctccagatcctagatccagactgtaagccctaacacttcactccacctcagatctatccaaagcccccagcaccagcccacccacctcagtcagagaaccaggaccccaaaggcatgcagagcccccacttccccactgtcttggccagccagggaccccagaagagaggttacaacccttcaggaatagggacaagctgctccctttgtaagaggatgtgagggaggctggctgggcccctgccagcaaacacaaatgaccctgcggcctggctcttctctctcctcccagctgcggcccttgcagctctgctcctggcacagagacaggagctactggctgagtgtaacagctggagggatggagggggaggggaggacgctccactccacgccagacagccccttctgcttgcaaatgagttagatccccatgcttctcctttcttctctccctcactcagtatcctcactcgaaagtctttgatgctggaaggtcatcccagccattctgctgctgctacacaggcccagccctaaacaaaataaccggggttctttggtcccaaaagatccccaggaaagagtaaacctccttaagacttaaggaaaaaagttggctaggcgtggtggctcacacctgtaatcccagcactttgggaggccgaggtgggcagaccacttgagatcaggagttcgagaccagcctggccaacgttgtgaaaccccgtctctacaaaatattagccgggtgtggcagtgcgtgcctgtagtcccaactactcaggaggctgaggcacaagaattgcttgagcctgggaggcggaggttgcagtgagccgagatcgtgccactgcactccagcccaggcgatggagcgagactctgtcccgcaaaaaaaaaaaaaaaaaa

SEQ ID NO: 507 - DNA, 464 bp, Artificial
  Synthetic oligonucleotide
aattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccag

SEQ ID NO: 508 - DNA, 277 bp, Artificial
  Synthetic oligonucleotide
tacgaccctgagcagctggacttggctgagaacatggtttctcagaacgacgggtctttcatttccaagaaggagtggtacgtgtagccccccttccagagcctctgtctgtgaccgctcctaaccagcccctccccgcacgccccctgcccaccccccacctcccactccaggagctgaacagagacttgcccagctgcccaaagccagccccgaactcctggggggccaggggagcccagggcagccacgacttggctttgtgttttatttcctc

SEQ ID NO: 509 - DNA, 37 bp, Artificial
  Synthetic oligonucleotide
gcgtccactcccaggtggtccaggtgaacgactccat

SEQ ID NO: 510 - DNA, 12 bp, Artificial
  Synthetic oligonucleotide
gtatggcttcat

SEQ ID NO: 511 - DNA, 97 bp, Artificial
  Synthetic oligonucleotide
ctggtgcccagcagggaagcccaccagcagtccttggcctgcatcgtcaactaccacatggaccgcttcaaggaaagcctcactctcaacgtgcagt

SEQ ID NO: 512 - DNA, 118 bp, Artificial
  Synthetic oligonucleotide
atgagcctgaggtaaccattgaggggtttgatggcaactggtacctgcagcggatggacgtgaagctcacctgcaaagctgatgctaaccccccagccactgagtaccactggaccac

SEQ ID NO: 513 - DNA, 13 bp, Artificial
  Synthetic oligonucleotide
gtcaatatcacag

SEQ ID NO: 514 - DNA, 107 bp, Artificial
  Synthetic oligonucleotide
ctttctgtcaacttatctatccgggcaaagggaggacaagagctaggatgttctgaggagagacttcacctgggacgtgaaaggagcatgggcttgatgtcagacag

SEQ ID NO: 515 - DNA, 20 bp, Artificial
  Synthetic oligonucleotide
ctgtgaccctggacagggcc

SEQ ID NO: 516 - DNA, 28 bp, Artificial
  Synthetic oligonucleotide
ccccccaccatctgtaaaacggggacag

SEQ ID NO: 517 - DNA, 112 bp, Artificial
  Synthetic oligonucleotide
tatgatgtaccttgaagggctgttgtcagaattctacgtgatgtaagtcaagcacctagcacagatcagtctgtcaataaatggccaatgttccgtgattattaccctgacc

SEQ ID NO: 518 - DNA, 264 bp, Artificial
  Synthetic oligonucleotide
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctga

SEQ ID NO: 519 - DNA, 156 bp, Artificial
  Synthetic oligonucleotide
ctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaa

SEQ ID NO: 520 - DNA, 141 bp, Artificial
  Synthetic oligonucleotide
ctccccaaccgggcagtggagccccagctgcaggaggaagagcggatggtgtatgtggccttctctgagttcttcttcgactctgccatggagagctacttccgggcgggggccctgcagctgttgctggtgggggacaag

SEQ ID NO: 521 - DNA, 419 bp, Artificial
  Synthetic oligonucleotide
ctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcc

SEQ ID NO: 522 - DNA, 232 bp, Artificial
  Synthetic oligonucleotide
gttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcag

SEQ ID NO: 523 - DNA, 280 bp, Artificial
  Synthetic oligonucleotide
cttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 524 - DNA, 73 bp, Artificial
  Synthetic oligonucleotide
gcccgctcgccatggccctcttcggggccctcttcctagcgctgctggcaggcgcacatgcagagttcccagg

SEQ ID NO: 525 - DNA, 18 bp, Artificial
  Synthetic oligonucleotide
ctgcaagatccgcgtcac

SEQ ID NO: 526 - DNA, 20 bp, Artificial
  Synthetic oligonucleotide
ctccaaggcgctggagctgg

SEQ ID NO: 527 - DNA, 8 bp, Artificial
  Synthetic oligonucleotide
tgaagcag

SEQ ID NO: 528 - DNA, 6 bp, Artificial
  Synthetic oligonucleotide
gagggg

SEQ ID NO: 529 - DNA, 35 bp, Artificial
  Synthetic oligonucleotide
ctgcgctttctggagcaagagctggagactatcac

SEQ ID NO: 530 - DNA, 51 bp, Artificial
  Synthetic oligonucleotide
cattccggacctgcggggcaaagaaggccacttctactacaacatctctga

SEQ ID NO: 531 - DNA, 92 bp, Artificial
  Synthetic oligonucleotide
gcctggacttgaaaggggagcagacaaatttcctgtcgttgggggaagttccctcttcttggccctggatctgaccctgaggcctcctgtag

SEQ ID NO: 532 - DNA, 16 bp, Artificial
  Synthetic oligonucleotide
ggtgaaggtcacagag

SEQ ID NO: 533 - DNA, 89 bp, Artificial
  Synthetic oligonucleotide
ctgcaactgacatcttccgagctcgatttccagccacagcaggagctgatgcttcaaatcaccaatgcctccttggggctgcgcttccg

SEQ ID NO: 534 - DNA, 24 bp, Artificial
  Synthetic oligonucleotide
gagacagctgctctactggttctt

SEQ ID NO: 535 - DNA, 52 bp, Artificial
  Synthetic oligonucleotide
gaaggtgtatgattttctctccacgttcatcacctcagggatgcgcttcctc

SEQ ID NO: 536 - DNA, 12 bp, Artificial
  Synthetic oligonucleotide
ctcaaccagcag

SEQ ID NO: 537 - DNA, 85 bp, Artificial
  Synthetic oligonucleotide
gtgtgggcagcgacaggtcgcagggtggcaagggtgggcatgctctcactttgagaaggccctgactctggctcccacctcgcag

SEQ ID NO: 538 - DNA, 64 bp, Artificial
  Synthetic oligonucleotide
atctgccctgtcctctaccacgcagggacggtcctgctcaactccctcctggacaccgtgcctg

SEQ ID NO: 539 - DNA, 7 bp, Artificial
  Synthetic oligonucleotide
tgcgcag

SEQ ID NO: 540 - DNA, 85 bp, Artificial
  Synthetic oligonucleotide
ttctgtggacgagcttgttggcattgactattccctcatgaaggatcctgtggcttccaccagcaacctggacatggacttccgg

SEQ ID NO: 541 - DNA, 36 bp, Artificial
  Synthetic oligonucleotide
ggggccttcttccccctgactgagaggaactggagc

SEQ ID NO: 542 - DNA, 45 bp, Artificial
  Synthetic oligonucleotide
gtgccccacgacctggacatgctgctgagggccacctactttggg

SEQ ID NO: 543 - DNA, 15 bp, Artificial
  Synthetic oligonucleotide
agcattgtcctgctg

SEQ ID NO: 544 - DNA, 30 bp, Artificial
  Synthetic oligonucleotide
agcccagcagtgattgactccccattgaag

SEQ ID NO: 545 - DNA, 87 bp, Artificial
  Synthetic oligonucleotide
ctggagctgcgggtcctggccccaccgcgctgcaccatcaagccctctggcaccaccatctctgtcactgctagcgtcaccattgcc

SEQ ID NO: 546 - DNA, 30 bp, Artificial
  Synthetic oligonucleotide
ctggtcccaccagaccagcctgaggtccag

SEQ ID NO: 547 - DNA, 18 bp, Artificial
  Synthetic oligonucleotide
ctgtccagcatgactatg

SEQ ID NO: 548 - DNA, 27 bp, Artificial
  Synthetic oligonucleotide
gacgcccgtctcagcgccaagatggct

SEQ ID NO: 549 - DNA, 41 bp, Artificial
  Synthetic oligonucleotide
ctccgggggaaggccctgcgcacgcagctggacctgcgcag

SEQ ID NO: 550 - DNA, 43 bp, Artificial
  Synthetic oligonucleotide
gttccgaatctattccaaccattctgcactggagtcgctggct

SEQ ID NO: 551 - DNA, 15 bp, Artificial
  Synthetic oligonucleotide
ctgatcccattacag

SEQ ID NO: 552 - DNA, 49 bp, Artificial
  Synthetic oligonucleotide
gcccctctgaagaccatgctgcagattggggtgatgcccatgctcaatg

SEQ ID NO: 553 - DNA, 83 bp, Artificial
  Synthetic oligonucleotide
gtaaggctggggtgtgaggatggaggaagaaaggaggggtgaactgggcgggcccagactgagcggggtgctcccacccacag

SEQ ID NO: 554 - DNA, 41 bp, Artificial
  Synthetic oligonucleotide
agcggacctggcgtggggtgcagatcccactacctgagggc

SEQ ID NO: 555 - DNA, 36 bp, Artificial
  Synthetic oligonucleotide
atcaactttgtgcatgaggtggtgacgaaccatgcg

SEQ ID NO: 556 - DNA, 24 bp, Artificial
  Synthetic oligonucleotide
ggattcctcaccatcggggctgat

SEQ ID NO: 557 - DNA, 36 bp, Artificial
  Synthetic oligonucleotide
ctccactttgccaaagggctgcgagaggtgattgag

SEQ ID NO: 558 - DNA, 23 bp, Artificial
  Synthetic oligonucleotide
aagaaccggcctgctgatgtcag

SEQ ID NO: 559 - DNA, 9 bp, Artificial
  Synthetic oligonucleotide
ggcgtccac

SEQ ID NO: 560 - DNA, 23 bp, Artificial
  Synthetic oligonucleotide
tgcccccacaccgtccacagcag

SEQ ID NO: 561 - DNA, 24 bp, Artificial
  Synthetic oligonucleotide
ctgtctgagccctcaatccccaag

SEQ ID NO: 562 - DNA, 7 bp, Artificial
  Synthetic oligonucleotide
ctggcag

SEQ ID NO: 563 - DNA, 20 bp, Artificial
  Synthetic oligonucleotide
ctgtcattcaggaccccaac

SEQ ID NO: 564 - DNA, 90 bp, Artificial
  Synthetic oligonucleotide
ccctctcagcccctcttttcccacattcatagcctgtagtgccccctctaacccccagtgccacagagaagacgggatttgaagctgtac

SEQ ID NO: 565 - DNA, 22 bp, Artificial
  Synthetic oligonucleotide
ccaatttaattccataatcaat

SEQ ID NO: 566 - DNA, 12 bp, Artificial
  Synthetic oligonucleotide
ctgaggagcaat

SEQ ID NO: 567 - DNA, 13 bp, Artificial
  Synthetic oligonucleotide
gcccagtccctac

SEQ ID NO: 568 - DNA, 105 bp, Artificial
  Synthetic oligonucleotide
cttgatcgtgagaaaggcgatgtgggagaactccttcacgaagccggcaatctgctccccgctgtccccgtacttcactaaccagggccggcgctgcacctccat

SEQ ID NO: 569 - DNA, 108 bp, Artificial
  Synthetic oligonucleotide
ctgccccaccaggaaagacatcagcctacagcagctgcatccttgctcacagctaccagcaagaccttagggctgggaattcctccacacttgccctctgtgggccag

SEQ ID NO: 570 - DNA, 90 bp, Artificial
  Synthetic oligonucleotide
agccaggcagccagctggccactcccaggcatacccgctcccaatcctccacagcagcccctatcccagggccaggaatctctaccttac

SEQ ID NO: 571 - DNA, 774 bp, Artificial
  Synthetic oligonucleotide
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccg

SEQ ID NO: 572 - DNA, 170 bp, Artificial
  Synthetic oligonucleotide
gtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatcta

SEQ ID NO: 573 - DNA, 175 bp, Artificial
  Synthetic oligonucleotide
cggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgcag

SEQ ID NO: 574 - DNA, 83 bp, Artificial
  Synthetic oligonucleotide
gcacctactttttcacctaccatgtcctcatgcgcggcggcgacggcaccagtatgtgggcagacctctgcaagaatggccag

SEQ ID NO: 575 - DNA, 102 bp, Artificial
  Synthetic oligonucleotide
ctccgactgagctccccacgtctccctccacccacgtccctcacccgccggggtcccctccgggcggggcagacgatgactcgcccctcgcccacccgctcg

SEQ ID NO: 576 - DNA, 115 bp, Artificial
  Synthetic oligonucleotide
ctgcccggccctccccggctatgacgcccccggcccgtgctcaacaccgcctgggccacagctaggccctcccaccggctcgctgcagagccgggcccagcgcgccctgtccccg

SEQ ID NO: 577 - DNA, 76 bp, Artificial
  Synthetic oligonucleotide
tgccagggaaccggggttgaccgcccccgcccagcccgcgctatatatttgtacaataggactgtttactgcccac

SEQ ID NO: 578 - DNA, 38 bp, Artificial
  Synthetic oligonucleotide
ctccgcctgccagcccaccccagcctggggagaggtcg

SEQ ID NO: 579 - DNA, 1098 bp, Artificial
  Synthetic oligonucleotide
tttttgtttgtgtacttaataaagggtaaatatgtcatgtttgtttggaacagtcatggttaatatctatgttgtcccagtatatctattaatagaactctctttcactctcaacagcgtcctagtccggatgacaaattatatggttatctctcagtaaagggtctttttttaaaatgatttttttttcagggggtagggtaggcaggaagcttaaactgggtaatttagttgtagaagagtgccctgtggcaaataattgattattcatttccagcatccccttttcttctccttgacagttattaaaaaaaaaaaagttaccagcttatgtcattttaaagaacactcgccctgaaaacttctgagaggttggccatttgaaaccctggttttagtgtctgtattattagtgaactaccgtgttcccatgtggctacacaaccacaattatgtactatctggctctttaccaaagtttgcagacctctaatctagagtgcgacatttcccctcattaactcttaggtcccttggctctaaaagggtatattcatcttggccctatacagggaaagggggaatgggattaatgatgtgctttgtaagaagaaccaattttaattttcacaaaggcttgacgtagctgtgagagaaagggtaagaagaagcaggcttcttcttagaagtctgagatggcctaaagtggtgggggaagaagggagagtggggagaaagagaaacaagaaaagctgagagtgaattccccagagaggtagccactgattctgccctactctttgctggaattctggaaaacacctgggcttctaaaagatagggagctcatgcatcatggtagggccacagctcaggctagggccagagatagctcagagtagcgccacggctcagggtaggtccacagtgcagggtagggccatagctcagagtagggccatagctcataaccacagctcagggtaggacctgctgatctatttggggacccccagcagagcctgtctaattgcatatcttgaaaaggattggaaaactgtcataatgacattattccctctcactttccttgtccag

SEQ ID NO: 580 - DNA, 259 bp, Artificial
  Synthetic oligonucleotide
gaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctg

SEQ ID NO: 581 - DNA, 201 bp, Artificial
  Synthetic oligonucleotide
ccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttacagtg

SEQ ID NO: 582 - DNA, 13 bp, Artificial
  Synthetic oligonucleotide
gtttttgcaagtg

SEQ ID NO: 583 - DNA, 11 bp, Artificial
  Synthetic oligonucleotide
ctgcatttccg

SEQ ID NO: 584 - DNA, 128 bp, Artificial
  Synthetic oligonucleotide
attttcaaacaccgcattccccttaaacctcccaggctcccatcactcccagcaaagagccagcccgctactttatggagacaggagagactgtcagacagttcctgctgctgcccaggtgcatctga

SEQ ID NO: 585 - DNA, 177 bp, Artificial
  Synthetic oligonucleotide
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccg

SEQ ID NO: 586 - DNA, 597 bp, Artificial
  Synthetic oligonucleotide
tgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcag

SEQ ID NO: 587 - DNA, 483 bp, Artificial
  Synthetic oligonucleotide
gcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacag

SEQ ID NO: 588 - DNA, 443 bp, Artificial
  Synthetic oligonucleotide
gctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccag

SEQ ID NO: 589 - DNA, 528 bp, Artificial
  Synthetic oligonucleotide
ctgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacag

SEQ ID NO: 590 - DNA, 1146 bp, Artificial
  Synthetic oligonucleotide
gtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatg

SEQ ID NO: 591 - DNA, 128 bp, Artificial
  Synthetic oligonucleotide
gtggtccgtactgagaagaacagtttgaacaaccgattcttaccctggaatgaaattgagacagaggccatcctgtccattgatgacgatgctcacctccgccatgacgaaatcatgtttgggttccg

SEQ ID NO: 592 - DNA, 145 bp, Artificial
  Synthetic oligonucleotide
ggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaag

SEQ ID NO: 593 - DNA, 412 bp, Artificial
  Synthetic oligonucleotide
gtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgag

SEQ ID NO: 594 - DNA, 245 bp, Artificial
  Synthetic oligonucleotide
cttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcag

SEQ ID NO: 595 - DNA, 617 bp, Artificial
  Synthetic oligonucleotide
ctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttat

SEQ ID NO: 596 - DNA, 238 bp, Artificial
  Synthetic oligonucleotide
ccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctag

SEQ ID NO: 597 - DNA, 128 bp, Artificial
  Synthetic oligonucleotide
tgtagagcaagccagtgtccttcgaggaacccacccggctggccgggaagttttacagcaaggcgcctgccttgggataattccttggtgaaattcaccttccccccgcctctgtctggagccccatc

SEQ ID NO: 598 - DNA, 242 bp, Artificial
  Synthetic oligonucleotide
ctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgac

SEQ ID NO: 599 - DNA, 156 bp, Artificial
  Synthetic oligonucleotide
gtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatac

SEQ ID NO: 600 - DNA, 730 bp, Artificial
  Synthetic oligonucleotide
cctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttggg

SEQ ID NO: 601 - DNA, 188 bp, Artificial
  Synthetic oligonucleotide
ctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 602 - DNA, 49 bp, Artificial
  Synthetic oligonucleotide
ggctgcagtggccgccgctggagaccgcgggacctggcgctgcagcgag

SEQ ID NO: 603 - DNA, 94 bp, Artificial
  Synthetic oligonucleotide
gagagcaagccctggaggttcactctttcaagaagtcgtgtgctgaggtgtaatgctacacaagtcagaggaaggaagggtcctgaaacacatg

SEQ ID NO: 604 - DNA, 24 bp, Artificial
  Synthetic oligonucleotide
cccaagctgtccctgcccatccga

SEQ ID NO: 605 - DNA, 79 bp, Artificial
  Synthetic oligonucleotide
tcctgagctcaggcaacctgcccgcctcggcctcccagagtgctgggattacaggcatgagccacggtgcccagcccag

SEQ ID NO: 606 - DNA, 77 bp, Artificial
  Synthetic oligonucleotide
atgggttctcactttattgttcaagctggtctgaaactcctggcctcgagcaagcctcccaagtgctgggattacag

SEQ ID NO: 607 - DNA, 36 bp, Artificial
  Synthetic oligonucleotide
tattatgcctacctgtattcttatgtgatgccccag

SEQ ID NO: 608 - DNA, 93 bp, Artificial
  Synthetic oligonucleotide
gccatccgggacatggtggatgaatacatcaactgtgaggacattgccatgaacttccttgtctcccacatcactcggaagccccccatcaag

SEQ ID NO: 609 - DNA, 92 bp, Artificial
  Synthetic oligonucleotide
gtgacctcacggtggacattccgatgcccaggatgccctcaggccctgtctcatgatgactcccacttccacgagcggcacaagtgcatcaa

SEQ ID NO: 610 - DNA, 54 bp, Artificial
  Synthetic oligonucleotide
caggaggagtggaaggaaaccgctgcctttatcttgaagtcagccacactgggc

SEQ ID NO: 611 - DNA, 41 bp, Artificial
  Synthetic oligonucleotide
ctgtgttatctgtggtttttggacccctaatgtcagcttgg

SEQ ID NO: 612 - DNA, 84 bp, Artificial
  Synthetic oligonucleotide
gttctcctctgacctgcctgtaccacgtgggtcctcttcaagtactgttttgaagctgggctcttttgtgtagctcccacccac

SEQ ID NO: 613 - DNA, 107 bp, Artificial
  Synthetic oligonucleotide
ctgtagggctagctcggcttaagggaactctccccattggcaaaccggacccggccgccgccaggactgtgtttccaaaggttccccgcccccaaccccagcatcag

SEQ ID NO: 614 - DNA, 86 bp, Artificial
  Synthetic oligonucleotide
ctgtcttaccataacaccgtcccagggctctgcaggccactgtgagcgctggctccctgggcagtgctcctccgtgtggactgtgc

SEQ ID NO: 615 - DNA, 28 bp, Artificial
  Synthetic oligonucleotide
ctcaggccagggctcaccagctggggtc

SEQ ID NO: 616 - DNA, 355 bp, Artificial
  Synthetic oligonucleotide
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggcc

SEQ ID NO: 617 - DNA, 148 bp, Artificial
  Synthetic oligonucleotide
cccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggg

SEQ ID NO: 618 - DNA, 125 bp, Artificial
  Synthetic oligonucleotide
acatgaatgaacacagctctagaagtcacagtatcttcctgataaatattaaacaagagaatgtagagactgaaaaaaaactcagtgggaaactttatttggttgatttggctgggagcgaaaag

SEQ ID NO: 619 - DNA, 147 bp, Artificial
  Synthetic oligonucleotide
ggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcag

SEQ ID NO: 620 - DNA, 125 bp, Artificial
  Synthetic oligonucleotide
gctgattgtccccatgaaggccagccttgaagcttggtcagtctccctaactgtatgattgatccccacttattgcactacatcactgagttcccgtatgccaagttatggccacttacatccac

SEQ ID NO: 621 - DNA, 149 bp, Artificial
  Synthetic oligonucleotide
aaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagag

SEQ ID NO: 622 - protein, 8 aa, Artificial
  Synthetic peptide
RGSLGSAQ

SEQ ID NO: 623 - DNA, 149 bp, Artificial
  Synthetic oligonucleotide
agctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatg

SEQ ID NO: 624 - DNA, 167 bp, Artificial
  Synthetic oligonucleotide
attttctagcagcacacgtgtttggaaagctactagaataattgaataattcagcacctgaggctggtggatgattctttgcaatttggcaggaatgggagagtcgggagcagtagttggcaaggtggggagtagccatatgaagttttatttcgggaatcctccag

SEQ ID NO: 625 - DNA, 176 bp, Artificial
  Synthetic oligonucleotide
gagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaag

SEQ ID NO: 626 - DNA, 504 bp, Artificial
  Synthetic oligonucleotide
gtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatttagaaaataaatgtctgactttcaaaaacccctgatgttttgagattgagtagccagtggctacagttcgttctggaagggcagagacctttggttgggtgatcaagcaaggatgatccttttttatttttatttttttgagacagggtctctctgttgtccaggctggaatgcagtggtgcaatcatggctcactgcaacctccagagctcaaatgatcttcccgcctaagactctcaagtagctaagactacaagaatgtgccaccatacctagctaattttttaatattttgagacagagtttctctatgttggtcagggtgatcttg

SEQ ID NO: 627 - DNA, 207 bp, Artificial
  Synthetic oligonucleotide
cttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacg

SEQ ID NO: 628 - DNA, 147 bp, Artificial
  Synthetic oligonucleotide
actacattgacaaccacacagagagagctgagccagctacaagagcttagcaaccaccagaagaaaagggcaactgagatcctgaatttgctgttgaaagatctgggggagataggtggaattattggcaccaatgatgtgaaaact

SEQ ID NO: 629 - DNA, 189 bp, Artificial
  Synthetic oligonucleotide
ttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccag

SEQ ID NO: 630 - DNA, 340 bp, Artificial
  Synthetic oligonucleotide
gtgagtcggcccagggcaccaggggtgtgggggtggtcatgcctcggtcctcttggggaagcctggaaggatgtggctcttagtcgagggccctgctcaccttgccctgtgggcactgccctggtgacacagcaggctgggcgggctgcttccaaggtctgttctccgatctggagctgagcctcctggagccctggcatggcaggtggcaggcgggcccagctgcctctcctagtccccgagggccagggtcacataggtgattccgctggatggacgcatgccccagtagatgggggggagcatctgtaatgaaagcaccaaaaaaaaaaaaaaaaaa

SEQ ID NO: 631 - DNA, 688 bp, Artificial
  Synthetic oligonucleotide
aagcttccctggcttgtgcctttcaaatggactctgggttttccttctggtagtgcatagctgttcctttacaggcgcttaggcgtggctctaggaaaggttttatgagtcctgggctgatgtaaatgttgaccaaacaccctcaaccagatggcgagtttctgtttgcagcagagcccaggctgtcttttcttcataattctctctgtgcccactcctcgagggcaggaactgtccctgtatcagtgaggcattcggacttgggagatgtttttagaacatcagaccagaaatgagggaaggtggaaatggccaaatcaggttccccaagtgactgcatgccatccgaggggccgaggaagcagagttcttctgacatgggctctctgttttaaaatatcagcccttctcccatctcattatttttcccctgaagctcttgcacaagcaaactataaatacatcctcaaagccttatgtttcatgactcttagatgcaccccagaaattagttttcacttgggcacggaggaagctgtgaggctgttctgtgatccctccaaatcctgcagaattactgcctttattgtacagagctaatagggttggaacagaaccacggttttagcctgatgactcagaatttcagactgatgtggaatatattgctttttcctctcaatttcag

SEQ ID NO: 632 - DNA, 136 bp, Artificial
  Synthetic oligonucleotide
gtgagttctctttgtctgaatgggactgagaagaaaatcaaagatggcagggaagaatcattttcagttgaaatatcacttgcttaagtcggggctggttatgcttaaaaattaattactgcacaccagagaatgt

SEQ ID NO: 633 - DNA, 217 bp, Artificial
  Synthetic oligonucleotide
ctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcg

SEQ ID NO: 634 - DNA, 1320 bp, Artificial
  Synthetic oligonucleotide
atatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgtt

SEQ ID NO: 635 - DNA, 933 bp, Artificial
  Synthetic oligonucleotide
gtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccacttt

SEQ ID NO: 636 - DNA, 1247 bp, Artificial
  Synthetic oligonucleotide
tttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 637 - DNA, 18 bp, Artificial
  Synthetic oligonucleotide
ccccacccatccccgtgc

SEQ ID NO: 638 - DNA, 91 bp, Artificial
  Synthetic oligonucleotide
caagggaagccatatgtcttcgacagagtgctacctcccaacacgacccaagagcaggtttacaatgcatgtgcgaagcaaattgtcaaag

SEQ ID NO: 639 - DNA, 74 bp, Artificial
  Synthetic oligonucleotide
atgtccttgaaggttataacgggacgatttttgcgtatgggcagacttcatcaggaaaaacccacaccatggag

SEQ ID NO: 640 - DNA, 105 bp, Artificial
  Synthetic oligonucleotide
gggaagctgcatgacccccagctcatggggatcatcccacgaattgcccatgatatctttgaccatatctactccatggatgagaacctggagtttcacataaag

SEQ ID NO: 641 - DNA, 49 bp, Artificial
  Synthetic oligonucleotide
gtttcctattttgagatctacttggacaaaataagggacttacttgatg

SEQ ID NO: 642 - DNA, 56 bp, Artificial
  Synthetic oligonucleotide
tatccaagaccaacttggctgttcatgaagataaaaacagagtcccgtatgtaaag

SEQ ID NO: 643 - DNA, 88 bp, Artificial
  Synthetic oligonucleotide
gggtgcactgagcggtttgtgtcgagccctgaggaagtcatggatgtaatagatgaaggcaaagcaaaccgacacgtggctgtgacaa

SEQ ID NO: 644 - DNA, 105 bp, Artificial
  Synthetic oligonucleotide
gtcagcaaaactggtgccgagggagctgttcttgacgaagctaaaaatatcaataagtctttgtctgctcttggaaatgtgatctctgctttggcagaagggaca

SEQ ID NO: 645 - DNA, 61 bp, Artificial
  Synthetic oligonucleotide
ggtatgaaatcaaggcttaggtgcaaagccattggataccatacctgagaccacacagcca

SEQ ID NO: 646 - DNA, 69 bp, Artificial
  Synthetic oligonucleotide
gatgatgaaattaaccagcagagccagctggctgaaaagctgaagcaacagatgttggatcaggatgag

SEQ ID NO: 647 - DNA, 118 bp, Artificial
  Synthetic oligonucleotide
cacgaagccaagatcaagtctctgacagactacatgcagaacatggaacagaagaggaggcagctagaagagtcccaggactcgctcagcgaagagctggcaaagctccgagcccagg

SEQ ID NO: 648 - DNA, 77 bp, Artificial
  Synthetic oligonucleotide
aaaaaatgcacgaagtcagcttccaggataaggagaaggaacatctgacgcggttgcaggatgctgaagaaatgaag

SEQ ID NO: 649 - DNA, 110 bp, Artificial
  Synthetic oligonucleotide
aaggcgctggagcagcagatggagagccaccgggaagctcaccagaagcagctgtccagactccgagacgaaattgaggagaagcagaaaatcattgatgagattcggga

SEQ ID NO: 650 - DNA, 102 bp, Artificial
  Synthetic oligonucleotide
tttgaatcagaaactgcaactggaacaggagaagcttagttctgattataacaagctgaaaatagaggaccaagagagagaaatgaagctggaaaagctctt

SEQ ID NO: 651 - DNA, 61 bp, Artificial
  Synthetic oligonucleotide
attgctcaacgataaaagggaacaagccagagaagacctcaaagggctggaggagacagtg

SEQ ID NO: 652 - DNA, 72 bp, Artificial
  Synthetic oligonucleotide
tctagagaattgcagacactgcacaaccttcggaaactctttgtccaggatctgaccacccgagttaaaaaa

SEQ ID NO: 653 - DNA, 105 bp, Artificial
  Synthetic oligonucleotide
agtgtggagttggacaacgatgatggagggggcagtgctgcccagaagcagaaaatttccttcttggagaataacctggagcagctcaccaaagttcacaagcag

SEQ ID NO: 654 - DNA, 114 bp, Artificial
  Synthetic oligonucleotide
ccaagcccatccgccccggacactacccggcctcatctccaacggccgtccatgccattcgagggggaggaggcagctcttcaaattccactcactaccagaaataaatacaaa

SEQ ID NO: 655 - DNA, 118 bp, Artificial
  Synthetic oligonucleotide
gtgtgcccaagatgagtgagctggcactgtgccctgaagctttcaccactgtaatgaaatatatgccaggggagactttgggcttttctcatgactgtgtgggtcgaaggtagctcaa

SEQ ID NO: 656 - DNA, 6 bp, Artificial
  Synthetic oligonucleotide
gtgtgt

SEQ ID NO: 657 - DNA, 6 bp, Artificial
  Synthetic oligonucleotide
gtgtgt

SEQ ID NO: 658 - DNA, 55 bp, Artificial
  Synthetic oligonucleotide
ctaaaaaagccacatatgtgcaattttcaggtttttagactattgctccctgtac

SEQ ID NO: 659 - DNA, 160 bp, Artificial
  Synthetic oligonucleotide
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccg

SEQ ID NO: 660 - DNA, 133 bp, Artificial
  Synthetic oligonucleotide
atgtacccggagctgcagattgcacgtgtggagcaggctacgcaggccatccccatggagcgctggtgcgggggttcccggagcggcagctgcgcccacccccaccaccaggttgtgcccttccgctgcctgc

SEQ ID NO: 661 - DNA, 134 bp, Artificial
  Synthetic oligonucleotide
gcctgcagctcccagggcctcatcctgcacggctcgggcatgctcttaccctgtggctcggatcggttccgtggtgtggagtatgtgtgctgtccccctccagggacccccgacccatctgggacagcagttgg

SEQ ID NO: 662 - DNA, 179 bp, Artificial
  Synthetic oligonucleotide
tgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaag

SEQ ID NO: 663 - DNA, 131 bp, Artificial
  Synthetic oligonucleotide
tcactcccaccccgaggcccacagacggtgtggatatttactttggcatgcctggggaaatcagtgagcacgaggggttcctgagggccaagatggacctggaggagcgtaggatgcgccagattaatgag

SEQ ID NO: 664 - DNA, 159 bp, Artificial
  Synthetic oligonucleotide
cacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcag

SEQ ID NO: 665 - DNA, 129 bp, Artificial
  Synthetic oligonucleotide
gcggagcgtgtcctgttggccctgcggcgctacctgcgtgcggagcagaaggaacagaggcacacgctgcgccactaccagcatgtggccgccgtggatcccgagaaggcacagcagatgcgcttccag

SEQ ID NO: 666 - DNA, 1643 bp, Artificial
  Synthetic oligonucleotide
tcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacag

SEQ ID NO: 667 - DNA, 872 bp, Artificial
  Synthetic oligonucleotide
gtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 668 - DNA, 259 bp, Artificial
  Synthetic oligonucleotide
gtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcag

SEQ ID NO: 669 - DNA, 463 bp, Artificial
  Synthetic oligonucleotide
gtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcag

SEQ ID NO: 670 - DNA, 121 bp, Artificial
  Synthetic oligonucleotide
gtaagaggaggaacagccgggtacctaggggaagagaccagaggtcagcggccaggctgtgattcccaaagccacacaggaccctcaaagaagccctctgccccatctcctctccctgcag

SEQ ID NO: 671 - DNA, 144 bp, Artificial
  Synthetic oligonucleotide
gcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggag

SEQ ID NO: 672 - DNA, 304 bp, Artificial
  Synthetic oligonucleotide
aaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 673 - DNA, 44 bp, Artificial
  Synthetic oligonucleotide
ctgctcgcggtctaagtcgccgcccgggccagccgccgctgccg

SEQ ID NO: 674 - DNA, 20 bp, Artificial
  Synthetic oligonucleotide
ctgctgctgccactattgct

SEQ ID NO: 675 - DNA, 64 bp, Artificial
  Synthetic oligonucleotide
gctgcttctgcgcgcgcagcccgccatcgggagcctggccggtgggagccccggcgcggccgag

SEQ ID NO: 676 - DNA, 82 bp, Artificial
  Synthetic oligonucleotide
gccccggggtcggcccaggtggctggactatgcgggcgcctaacccttcaccgggacctgcgcaccggccgctgggaaccag

SEQ ID NO: 677 - DNA, 62 bp, Artificial
  Synthetic oligonucleotide
acccacagcgctctcgacgctgtctccgggacccgcagcgcgtgctggagtactgcagacag

SEQ ID NO: 678 - DNA, 113 bp, Artificial
  Synthetic oligonucleotide
ctggtgaatttgtgagtgaggccctgctggtgcctgaaggctgccggttcttgcaccaggagcgcatggaccaatgtgagagttcaacccggaggcatcaggaggcacaggag

SEQ ID NO: 679 - DNA, 75 bp, Artificial
  Synthetic oligonucleotide
gtgatgcgtgaatgggccatggcagacaaccagtccaagaacctgcctaaagccgacagacaggccctgaatgag

SEQ ID NO: 680 - DNA, 4 bp, Artificial
  Synthetic oligonucleotide
gtgc

SEQ ID NO: 681 - DNA, 72 bp, Artificial
  Synthetic oligonucleotide
gtgcatacccaccttcaagtgattgaggagagggtgaatcagagcctgggcctgcttgaccagaacccccac

SEQ ID NO: 682 - DNA, 28 bp, Artificial
  Synthetic oligonucleotide
ctggctcaggagctgcggccccaaatcc

SEQ ID NO: 683 - DNA, 108 bp, Artificial
  Synthetic oligonucleotide
aggaactcctccactctgaacacctgggtcccagtgaattggaagcccctgcccctgggggcagcagcgaggacaagggtgggctgcagcctccagattccaaggatg

SEQ ID NO: 684 - DNA, 24 bp, Artificial
  Synthetic oligonucleotide
acacccccatgacccttccaaaag

SEQ ID NO: 685 - DNA, 12 bp, Artificial
  Synthetic oligonucleotide
acttgggggtag

SEQ ID NO: 686 - DNA, 9 bp, Artificial
  Synthetic oligonucleotide
ggtccacag

SEQ ID NO: 687 - DNA, 62 bp, Artificial
  Synthetic oligonucleotide
aacaagatgctgcatcccctgagaaagagaagatgaacccgctggaacagtatgagcgaaag

SEQ ID NO: 688 - DNA, 63 bp, Artificial
  Synthetic oligonucleotide
gtgaatgcgtctgttccaaggggtttccctttccactcatcggagattcagagggatgagctg

SEQ ID NO: 689 - DNA, 36 bp, Artificial
  Synthetic oligonucleotide
gtggaccccatgctgaccctggaggagcagcagctc

SEQ ID NO: 690 - DNA, 39 bp, Artificial
  Synthetic oligonucleotide
cgcgaactgcagcggcacggctatgagaaccccacttac

SEQ ID NO: 691 - DNA, 59 bp, Artificial
  Synthetic oligonucleotide
cgcttcctggaggaacgaccctgacccggcccccttcaccccttcagccgagcccagac

SEQ ID NO: 692 - DNA, 17 bp, Artificial
  Synthetic oligonucleotide
ctcccctcttcctggag

SEQ ID NO: 693 - DNA, 6 bp, Artificial
  Synthetic oligonucleotide
ccccag

SEQ ID NO: 694 - protein, 20 aa, Artificial
  Synthetic peptide
GEGHSLPISPGVLQTQNCGP

SEQ ID NO: 695 - DNA, 307 bp, Artificial
  Synthetic oligonucleotide
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccag

SEQ ID NO: 696 - DNA, 447 bp, Artificial
  Synthetic oligonucleotide
gtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 697 - DNA, 523 bp, Artificial
  Synthetic oligonucleotide
gtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 698 - DNA, 1288 bp, Artificial
  Synthetic oligonucleotide
ctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttag

SEQ ID NO: 699 - DNA, 439 bp, Artificial
  Synthetic oligonucleotide
gctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 700 - DNA, 88 bp, Artificial
  Synthetic oligonucleotide
tccgggcgcggaggtttgcgcgccttggtgagccgttggcgtggtggtcccggagtgatcctggcagccggtggggaagacaaggagg

SEQ ID NO: 701 - DNA, 92 bp, Artificial
  Synthetic oligonucleotide
gtttgagcatggcagaaggaaacaccctgatatcagtggattatgaaatttttgggaaggtgcaaggggtgtttttccgtaagcatactcag

SEQ ID NO: 702 - DNA, 79 bp, Artificial
  Synthetic oligonucleotide
gaaatgactgttgaaaacagaattgctgaaactcacagcaagagctgtgttccagttagctttgctaccagttatgcag

SEQ ID NO: 703 - DNA, 77 bp, Artificial
  Synthetic oligonucleotide
ttttgagacagagtcttgctctgttgcctaggctaaagtgcagtagtgcgatctcggctcactgcaacctccacttc

SEQ ID NO: 704 - DNA, 114 bp, Artificial
  Synthetic oligonucleotide
ctttgtttttgggaggctgaggaaggaggatcatttgagcctgggaggttaaggctgcaataagctgtgactgtgccaccatccttcagaaaaaaaaaagaaaaaggaaaagag

SEQ ID NO: 705 - DNA, 49 bp, Artificial
  Synthetic oligonucleotide
ctatttaccatataagataactcttaagaactggagatagtcagctccc

SEQ ID NO: 706 - DNA, 287 bp, Artificial
  Synthetic oligonucleotide
gctacggaagggttttcagcagggagagatgggaccagcatgctctccatcctgttgccccgcctcacgtctggcccctgcttctccagtcccccaccccagaccacacacgaagaagcagtcctgtcctcagcccagccctcacctcccccgacctgccatcctgcttcatgctcagggcggtgtgtggagcgcccggggctctggacccgcgctgccagataacaatgctctcgttgtctctttgctcccatctctgggggcctctgattctttctgctctacag

SEQ ID NO: 707 - DNA, 138 bp, Artificial
  Synthetic oligonucleotide
ggccgttcctggccggttctccggagttacgatgactttcgttccctggatgcccacctccaccggtgcatatttgaccggaggttctcctgccttccggagcttcccccgccccccgagggtgccagggctgcccag

SEQ ID NO: 708 - DNA, 140 bp, Artificial
  Synthetic oligonucleotide
gcgtgtgccaccacgcccagcacagagagattttagatggcaaccgtgtggcatctgctgtggaggatgaaggtgcagaggtggatggggaagccttcaggtggggaagcctttgggtgggagagtcctgggacatgtga

SEQ ID NO: 709 - DNA, 123 bp, Artificial
  Synthetic oligonucleotide
ctggacaatcacggccggcgactgctcctcagtgaggaggcgtcactcaatatccctgcagtggcggccgcccatgtgatcaaacggtatacagcccaggcgccagatgagctgtcctttgag

SEQ ID NO: 710 - DNA, 153 bp, Artificial
  Synthetic oligonucleotide
ctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatg

SEQ ID NO: 711 - DNA, 145 bp, Artificial
  Synthetic oligonucleotide
gcacgagtttgacagtgagaggatcccggagctgtctggccctgcattcctgcaggacatccacagcgtgtcctccctctgcaagctctacttccgagagcttccgaaccctctgctcacctaccagctctatgggaagttcagt

SEQ ID NO: 712 - DNA, 146 bp, Artificial
  Synthetic oligonucleotide
gtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcag

SEQ ID NO: 713 - DNA, 154 bp, Artificial
  Synthetic oligonucleotide
gccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaag

SEQ ID NO: 714 - DNA, 348 bp, Artificial
  Synthetic oligonucleotide
gcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcacccc

SEQ ID NO: 715 - DNA, 123 bp, Artificial
  Synthetic oligonucleotide
ccgcccctgcctctgccttcccacccagggtgaccccccaggccatctcgccccgggggcccaccagccccgcctcgcctgctgccctagacatctcagagcccctggctgtatcagtgccac

SEQ ID NO: 716 - DNA, 177 bp, Artificial
  Synthetic oligonucleotide
aactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcg

SEQ ID NO: 717 - DNA, 392 bp, Artificial
  Synthetic oligonucleotide
gtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccag

SEQ ID NO: 718 - DNA, 311 bp, Artificial
  Synthetic oligonucleotide
gttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacag

SEQ ID NO: 719 - DNA, 206 bp, Artificial
  Synthetic oligonucleotide
ctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacag

SEQ ID NO: 720 - DNA, 426 bp, Artificial
  Synthetic oligonucleotide
ggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctcc

SEQ ID NO: 721 - DNA, 98 bp, Artificial
  Synthetic oligonucleotide
gcacgcagcactgacagcctggatggcccaggggagggctcggtgcagcctctacccactgctggggggcccagtgtgaaggggaagcctgggaagag

SEQ ID NO: 722 - DNA, 85 bp, Artificial
  Synthetic oligonucleotide
gctctcagctcctcgaggccccttcccgcggctggctgactgcgcccatttccactacgagaacgttgactttggccacattcag

SEQ ID NO: 723 - DNA, 81 bp, Artificial
  Synthetic oligonucleotide
ctcctgctgtctccagaccgtgaagggcccagcctctctggagagaatgagctggtgttcggggtgcaggtgacctgtcag

SEQ ID NO: 724 - DNA, 93 bp, Artificial
  Synthetic oligonucleotide
atgctggtgccactgctgctgcagtacctggagacactgtcaggactggtggacagtaacctcaactgcgggcctgtgctcacctggatggag

SEQ ID NO: 725 - DNA, 46 bp, Artificial
  Synthetic oligonucleotide
gtgggcctgggcagggggcttggagattccgagtgggtgagggggt

SEQ ID NO: 726 - DNA, 78 bp, Artificial
  Synthetic oligonucleotide
gtgggagacattgtctcggtgatcgacatgccacccacagaggatcggagctggtggcggggcaagcgaggcttccag

SEQ ID NO: 727 - DNA, 67 bp, Artificial
  Synthetic oligonucleotide
gtcgggttcttccccagtgagtgtgtggaactcttcacagagcggccaggtccgggcctgaaggcgg

SEQ ID NO: 728 - DNA, 60 bp, Artificial
  Synthetic oligonucleotide
atgccgatggccccccatgtggcatcccggctccccagggtatctcgtctctgacctcag

SEQ ID NO: 729 - DNA, 103 bp, Artificial
  Synthetic oligonucleotide
tgccccaggtgctgcgctgctgctccgagttcattgaggcccacggggtggtggatgggatctaccggctctcaggcgtgtcttccaacatccagaggcttcg

SEQ ID NO: 730 - DNA, 83 bp, Artificial
  Synthetic oligonucleotide
gaggccatgtcagtgcctggggaggaggagcgtctggtgcgggtgcacgatgtcatccagcagctgcccccaccacattacag

SEQ ID NO: 731 - DNA, 108 bp, Artificial
  Synthetic oligonucleotide
gaccctggagtacctgctgaggcacctggcccgcatggcgagacacagtgccaacaccagcatgcatgcccgcaacctggccattgtctgggcacccaacctgctacg

SEQ ID NO: 732 - DNA, 89 bp, Artificial
  Synthetic oligonucleotide
gaggaaaggggagagaggggagaagcagcggaagccagggggcagcagctggaagacgttctttgcactgggccggggccccagtgtcc

SEQ ID NO: 733 - DNA, 57 bp, Artificial
  Synthetic oligonucleotide
ctcgaaagaagcccctgccctggctggggggcacccgtgccccaccgcagccttcag

SEQ ID NO: 734 - DNA, 75 bp, Artificial
  Synthetic oligonucleotide
gcagcagacccgacaccgtcacactgagatctgccaagagcgaggagtctctgtcatcgcaggccagcggggctg

SEQ ID NO: 735 - DNA, 12 bp, Artificial
  Synthetic oligonucleotide
ccgctgtcctag

SEQ ID NO: 736 - DNA, 84 bp, Artificial
  Synthetic oligonucleotide
gtcagtgcccagctcagggcaggtggcgggggcagggatgcgccagaggcagcagcccagtccccatgttctgtcccctcacag

SEQ ID NO: 737 - DNA, 50 bp, Artificial
  Synthetic oligonucleotide
gtcccccgacttcctgctcagctacccgccagccccctcctgctttcccc

SEQ ID NO: 738 - DNA, 62 bp, Artificial
  Synthetic oligonucleotide
ctgaccaccttggctactcagccccccagcaccctgctcggcgccctacaccgcctgagccc

SEQ ID NO: 739 - DNA, 6 bp, Artificial
  Synthetic oligonucleotide
ctccag

SEQ ID NO: 740 - DNA, 52 bp, Artificial
  Synthetic oligonucleotide
gagcccccagcatgtcctgacctgtgcacggggatggggggacaactcctac

SEQ ID NO: 741 - DNA, 67 bp, Artificial
  Synthetic oligonucleotide
ccttctttccccacatgccccactaaaccatctgacaacattaatgaataaaatggtgaaaatgtga

SEQ ID NO: 742 - DNA, 424 bp, Artificial
  Synthetic oligonucleotide
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggag

SEQ ID NO: 743 - DNA, 168 bp, Artificial
  Synthetic oligonucleotide
ctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccag

SEQ ID NO: 744 - DNA, 214 bp, Artificial
  Synthetic oligonucleotide
gtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaa

SEQ ID NO: 745 - DNA, 163 bp, Artificial
  Synthetic oligonucleotide
gtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgag

SEQ ID NO: 746 - DNA, 129 bp, Artificial
  Synthetic oligonucleotide
ggggacattcagcagtttttgatcacaggtgatcccaaggcagcatatgactactgtgagcattatagtccagactgtgactcttcagcacccaaggctgctcaagctcaggaacctcagatagatgag

SEQ ID NO: 747 - DNA, 215 bp, Artificial
  Synthetic oligonucleotide
gtgaggagcacaagaccagagaaggtcttcgtatttcagtgatatggacatagcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataa

SEQ ID NO: 748 - DNA, 214 bp, Artificial
  Synthetic oligonucleotide
ccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttg

SEQ ID NO: 749 - DNA, 430 bp, Artificial
  Synthetic oligonucleotide
gtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtctttttccctgatctccactgtgagattccttgagtaatattttgtcccctgtagtcatagcacatttctatctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacag

SEQ ID NO: 750 - DNA, 639 bp, Artificial
  Synthetic oligonucleotide
atgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 751 - DNA, 129 bp, Artificial
  Synthetic oligonucleotide
gtaagtatgatgataataaatagccagacaatcatggttgtgaattacagctcttctttcattactctcatgctgtgattccacagtgtgtgggagagaaaataaacacatgtcaatcaaatcagtcaa

SEQ ID NO: 752 - DNA, 117 bp, Artificial
  Synthetic oligonucleotide
tatgcaccagaggatataatcgaatatgactatgagtatggggaagcagagtataaagaggctgaaagtgtaacagagggacccactgtaactgaggagacaatagcacagacggag

SEQ ID NO: 753 - DNA, 93 bp, Artificial
  Synthetic oligonucleotide
gcaaacatcgttgatgattttcaagaatacaactatggaacaatggaaagttaccagacagaagctcctaggcatgtttctgggacaaatgag

SEQ ID NO: 754 - DNA, 41 bp, Artificial
  Synthetic oligonucleotide
gtccaggtgtaccagcagaaactgatattacagaaacaagc

SEQ ID NO: 755 - DNA, 63 bp, Artificial
  Synthetic oligonucleotide
ataaatggccatggtgcatatggagagaaaggacagaaaggagaaccagcagtggttgagcct

SEQ ID NO: 756 - DNA, 42 bp, Artificial
  Synthetic oligonucleotide
ggtatgcttgtcgaaggaccaccaggaccagcaggacctgca

SEQ ID NO: 757 - DNA, 63 bp, Artificial
  Synthetic oligonucleotide
ggtattatgggtcctccaggtctacaaggccccactggaccccctggtgaccctggcgatagg

SEQ ID NO: 758 - DNA, 75 bp, Artificial
  Synthetic oligonucleotide
ggccccccaggacgtcctggcttaccaggggctgatggtctacctggtcctcctggtactatgttgatgttaccg

SEQ ID NO: 759 - DNA, 84 bp, Artificial
  Synthetic oligonucleotide
ttccgttatggtggtgatggttccaaaggaccaaccatctctgctcaggaagctcaggctcaagctattcttcagcaggctcgg

SEQ ID NO: 760 - DNA, 57 bp, Artificial
  Synthetic oligonucleotide
attgctctgagaggcccacctggcccaatgggtctaactggaagaccaggtcctgtg

SEQ ID NO: 761 - DNA, 54 bp, Artificial
  Synthetic oligonucleotide
ggggggcctggttcatctggggccaaaggtgagagtggtgatccaggtcctcag

SEQ ID NO: 762 - DNA, 54 bp, Artificial
  Synthetic oligonucleotide
ggccctcgaggcgtccagggtccccctggtccaacgggaaaacctggaaaaagg

SEQ ID NO: 763 - DNA, 54 bp, Artificial
  Synthetic oligonucleotide
ggtcgtccaggtgcagatggaggaagaggaatgccaggagaacctggggcaaag

SEQ ID NO: 764 - DNA, 54 bp, Artificial
  Synthetic oligonucleotide
ggagatcgagggtttgatggacttccgggtctgccaggtgacaaaggtcacagg

SEQ ID NO: 765 - DNA, 54 bp, Artificial
  Synthetic oligonucleotide
ggtgaacgaggtcctcaaggtcctccaggtcctcctggtgatgatggaatgagg

SEQ ID NO: 766 - DNA, 45 bp, Artificial
  Synthetic oligonucleotide
ggagaagatggagaaattggaccaagaggtcttccaggtgaagct

SEQ ID NO: 767 - DNA, 54 bp, Artificial
  Synthetic oligonucleotide
ggcccacgaggtttgctgggtccaaggggaactccaggagctccagggcagcct

SEQ ID NO: 768 - DNA, 45 bp, Artificial
  Synthetic oligonucleotide
ggtatggcaggtgtagatggccccccaggaccaaaagggaacatg

SEQ ID NO: 769 - DNA, 54 bp, Artificial
  Synthetic oligonucleotide
ggtccccaaggggagcctgggcctccaggtcaacaagggaatccaggacctcag

SEQ ID NO: 770 - DNA, 45 bp, Artificial
  Synthetic oligonucleotide
ggtcttcctggtccacaaggtccaattggtcctcctggtgaaaaa

SEQ ID NO: 771 - DNA, 54 bp, Artificial
  Synthetic oligonucleotide
ggaccacaaggaaaaccaggacttgctggacttcctggtgctgatgggcctcct

SEQ ID NO: 772 - DNA, 45 bp, Artificial
  Synthetic oligonucleotide
ggtcatcctgggaaagaaggccagtctggagaaaagggggctctg

SEQ ID NO: 773 - DNA, 54 bp, Artificial
  Synthetic oligonucleotide
ggtccccctggtccacaaggtcctattggatacccgggcccccggggagtaaag

SEQ ID NO: 774 - DNA, 45 bp, Artificial
  Synthetic oligonucleotide
ggagcagatggtgtcagaggtctcaagggatctaaaggtgaaaag

SEQ ID NO: 775 - DNA, 54 bp, Artificial
  Synthetic oligonucleotide
ggtgaagatggttttccaggattcaaaggtgacatgggtctaaaaggtgacaga

SEQ ID NO: 776 - DNA, 108 bp, Artificial
  Synthetic oligonucleotide
ggagaagttggtcaaattggcccaagaggggaagatggccctgaaggacccaaaggtcgagcaggcccaactggagacccaggtccttcaggtcaagcaggagaaaag

SEQ ID NO: 777 - DNA, 54 bp, Artificial
  Synthetic oligonucleotide
ggaaaacttggagttccaggattaccaggatatccaggaagacaaggtccaaag

SEQ ID NO: 778 - DNA, 54 bp, Artificial
  Synthetic oligonucleotide
ggttccactggattccctgggtttccaggtgccaatggagagaaaggtgcacgg

SEQ ID NO: 779 - DNA, 45 bp, Artificial
  Synthetic oligonucleotide
ggagtagctggcaaaccaggccctcggggtcagcgtggtccaacg

SEQ ID NO: 780 - DNA, 54 bp, Artificial
  Synthetic oligonucleotide
ggtcctcgaggttcaagaggtgcaagaggtcccactgggaaacctgggccaaag

SEQ ID NO: 781 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 782 - DNA, 45 bp, Artificial
  Synthetic oligonucleotide
ggcacttcaggtggcgatggccctcctggccctccaggtgaaaga

SEQ ID NO: 783 - DNA, 54 bp, Artificial
  Synthetic oligonucleotide
ggtcctcaaggacctcagggtccagttggattccctggaccaaaaggccctcct

SEQ ID NO: 784 - DNA, 54 bp, Artificial
  Synthetic oligonucleotide
ggaccacctgggaaggatgggctgccaggacaccctgggcaacgtggggagact

SEQ ID NO: 785 - DNA, 54 bp, Artificial
  Synthetic oligonucleotide
ggatttcaaggcaagaccggccctcctgggccagggggagtggttggaccacag

SEQ ID NO: 786 - DNA, 108 bp, Artificial
  Synthetic oligonucleotide
ggaccaaccggtgagactggtccaataggggaacgtgggcatcctggccctcctggccctcctggtgagcaaggtcttcctggtgctgcaggaaaagaaggtgcaaag

SEQ ID NO: 787 - DNA, 90 bp, Artificial
  Synthetic oligonucleotide
ggtgatccaggtcctcaaggtatctcagggaaagatggaccagcaggattacgtggtttcccaggggaaagaggtcttcctggagctcag

SEQ ID NO: 788 - DNA, 54 bp, Artificial
  Synthetic oligonucleotide
ggtgcacctggactgaaaggaggggaaggtccccagggcccaccaggtccagtt

SEQ ID NO: 789 - DNA, 211 bp, Artificial
  Synthetic oligonucleotide
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctgg

SEQ ID NO: 790 - DNA, 131 bp, Artificial
  Synthetic oligonucleotide
cccagatttaccaaagggaattgtcagctgtccaagggctagcaaattcctaggtcacctagattggattttctgaccataaaaactgtgggccaggtgcacagctgcctgaggggctcaaacctgtgcag

SEQ ID NO: 791 - DNA, 214 bp, Artificial
  Synthetic oligonucleotide
tcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaag

SEQ ID NO: 792 - DNA, 140 bp, Artificial
  Synthetic oligonucleotide
gccttatttctctgctggttgagcgaagggattgtcttccatggtctccgagatcccgtcccacgctcatgccctagaattctctgagtccttgatgcacttttgcctttggcgaggaggcaggacagtcaggcgtggag

SEQ ID NO: 793 - DNA, 143 bp, Artificial
  Synthetic oligonucleotide
ctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 794 - DNA, 130 bp, Artificial
  Synthetic oligonucleotide
ccccacccatctgggccccgggttcaagagagagcggggtctgatctcgtgtagccatatagagtttgcttctgagtgtctgctttgtttagtagaggtgggcaggaggagctgaggggctggggctggg

SEQ ID NO: 795 - DNA, 140 bp, Artificial
  Synthetic oligonucleotide
ctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 796 - DNA, 93 bp, Artificial
  Synthetic oligonucleotide
tgtctctgagagcattgatgaggtcaggaagcctcctgttgggtagaggagcaactaagagactgaacttggcccccaccctgaggctcacaa

SEQ ID NO: 797 - DNA, 103 bp, Artificial
  Synthetic oligonucleotide
gcttgaattgcacctgagttccaaaggagaagttgacattcttccagaacatatgcccagtgtcttcaacttgagatggagctgggatgccaagtctgcaaat

SEQ ID NO: 798 - DNA, 47 bp, Artificial
  Synthetic oligonucleotide
cttggctggaggctctgcgaggacagctggggagaaggggagctgtg

SEQ ID NO: 799 - DNA, 18 bp, Artificial
  Synthetic oligonucleotide
atggaggctcgctctgtt

SEQ ID NO: 800 - DNA, 98 bp, Artificial
  Synthetic oligonucleotide
gccaggctggagtacagcgatctcggctcactgcaacctctgcctcccgggttcaagtgattctcctgcctcagcctcccaagtagctgggactacag

SEQ ID NO: 801 - DNA, 96 bp, Artificial
  Synthetic oligonucleotide
gtataaaaacgcccttgggaccaggcagcctcaaaccccagctgttggggccaggacacccagtgagcccatacttgctctttttgtcttcttcag

SEQ ID NO: 802 - DNA, 78 bp, Artificial
  Synthetic oligonucleotide
actgcgccatggggctcagcgacggggaatggcagttggtgctgaacgtctgggggaaggtggaggctgacatcccag

SEQ ID NO: 803 - DNA, 25 bp, Artificial
  Synthetic oligonucleotide
gccatgggcaggaagtcctcatcag

SEQ ID NO: 804 - DNA, 80 bp, Artificial
  Synthetic oligonucleotide
gctctttaagggtcacccagagactctggagaagtttgacaagttcaagcacctgaagtcagaggacgagatgaaggcgt

SEQ ID NO: 805 - DNA, 84 bp, Artificial
  Synthetic oligonucleotide
ttcatctcggaatgcatcatccaggttctgcagagcaagcatcccggggactttggtgctgatgcccagggggccatgaacaag

SEQ ID NO: 806 - DNA, 29 bp, Artificial
  Synthetic oligonucleotide
gccctggagctgttccggaaggacatggc

SEQ ID NO: 807 - DNA, 28 bp, Artificial
  Synthetic oligonucleotide
ctccaactacaaggagctgggcttccag

SEQ ID NO: 808 - DNA, 23 bp, Artificial
  Synthetic oligonucleotide
ggctaggcccctgccgctcccac

SEQ ID NO: 809 - DNA, 13 bp, Artificial
  Synthetic oligonucleotide
gtgttgaagttgg

SEQ ID NO: 810 - DNA, 22 bp, Artificial
  Synthetic oligonucleotide
ctttgcatgcccagcgatgcgc

SEQ ID NO: 811 - DNA, 45 bp, Artificial
  Synthetic oligonucleotide
ctccctgtgggatgtcatcaccctgggaaccgggagtggcccttg

SEQ ID NO: 812 - DNA, 56 bp, Artificial
  Synthetic oligonucleotide
gctcactgtgttctgcatggtttggatctgaattaattgtcctttcttctaaatcc

SEQ ID NO: 813 - DNA, 118 bp, Artificial
  Synthetic oligonucleotide
caaccgaacttcttccaacctccaaactggctgtaaccccaaatccaagccattaactacacctgacagtagcaattgtctgattaatcactggccccttgaagacagcagaatgtcc

SEQ ID NO: 814 - DNA, 178 bp, Artificial
  Synthetic oligonucleotide
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacag

SEQ ID NO: 815 - DNA, 278 bp, Artificial
  Synthetic oligonucleotide
cctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccag

SEQ ID NO: 816 - DNA, 400 bp, Artificial
  Synthetic oligonucleotide
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccag

SEQ ID NO: 817 - DNA, 255 bp, Artificial
  Synthetic oligonucleotide
atggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatg

SEQ ID NO: 818 - DNA, 190 bp, Artificial
  Synthetic oligonucleotide
ctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctg

SEQ ID NO: 819 - DNA, 127 bp, Artificial
  Synthetic oligonucleotide
ctgtccaatggcaacaggaccctcactctattcaatgtcacaagaaatgacgcaagagcctatgtatgtggaatccagaactcagtgagtgcaaaccgcagtgacccagtcaccctggatgtcctct

SEQ ID NO: 820 - DNA, 255 bp, Artificial
  Synthetic oligonucleotide
atgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctg

SEQ ID NO: 821 - DNA, 1174 bp, Artificial
  Synthetic oligonucleotide
ctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacactttttccccaaatgagaggaggaagccccttggatgaggcaggagcagctcagactctgctccctgctctgcgcccggctcacccggtgactggctctgccctggctccacttggggtgggaccggggcatgtggagaaggtgtccaggtggcctgttttgaatctgggtaaatcaagctgccaatccacagcagagcctcccttgggtcaggttgcagggaaatgggaaaagagggagcctcgggacagactcctgagctgtgtcctggctctgaagtcactggctgtatgaggctgtggacacagcacataggacacagcagaggaaagtgagtgacacacacttggagaaatagggagattcagccataggggctctgcatgggagggaacaggcagtgccaaaaagtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaaaaaaaaaaaaaaagg

SEQ ID NO: 822 - DNA, 179 bp, Artificial
  Synthetic oligonucleotide
ctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgagg

SEQ ID NO: 823 - DNA, 732 bp, Artificial
  Synthetic oligonucleotide
tttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 824 - DNA, 280 bp, Artificial
  Synthetic oligonucleotide
cggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 825 - DNA, 82 bp, Artificial
  Synthetic oligonucleotide
aatgacacaggattctacaccctacacgtcataaagtcagatcttgtgaatgaagaagcaactggccagttccgggtatacc

SEQ ID NO: 826 - DNA, 104 bp, Artificial
  Synthetic oligonucleotide
cggagctgcccaagccctccatctccagcaacaactccaaacccgtggaggacaaggatgctgtggccttcacctgtgaacctgagactcaggacgcaacctac

SEQ ID NO: 827 - DNA, 48 bp, Artificial
  Synthetic oligonucleotide
ctgtggtgggtaaacaatcagagcctcccggtcagtcccaggctgcag

SEQ ID NO: 828 - DNA, 48 bp, Artificial
  Synthetic oligonucleotide
ctgtccaatggcaacaggaccctcactctattcaatgtcacaagaaat

SEQ ID NO: 829 - DNA, 79 bp, Artificial
  Synthetic oligonucleotide
gacacagcaagctacaaatgtgaaacccagaacccagtgagtgccaggcgcagtgattcagtcatcctgaatgtcctct

SEQ ID NO: 830 - DNA, 3 bp, Artificial
  Synthetic oligonucleotide
cag

SEQ ID NO: 831 - DNA, 6 bp, Artificial
  Synthetic oligonucleotide
agccac

SEQ ID NO: 832 - DNA, 7 bp, Artificial
  Synthetic oligonucleotide
ccaaacc

SEQ ID NO: 833 - DNA, 18 bp, Artificial
  Synthetic oligonucleotide
cttcatcaccagcaacaa

SEQ ID NO: 834 - DNA, 70 bp, Artificial
  Synthetic oligonucleotide
ctccaaccccgtggaggatgaggatgctgtagccttaacctgtgaacctgagattcagaacacaacctac

SEQ ID NO: 835 - DNA, 24 bp, Artificial
  Synthetic oligonucleotide
ctgtggtgggtaaataatcagagc

SEQ ID NO: 836 - DNA, 24 bp, Artificial
  Synthetic oligonucleotide
ctcccggtcagtcccaggctgcag

SEQ ID NO: 837 - DNA, 78 bp, Artificial
  Synthetic oligonucleotide
ctgtccaatgacaacaggaccctcactctactcagtgtcacaaggaatgatgtaggaccctatgagtgtggaatccag

SEQ ID NO: 838 - DNA, 30 bp, Artificial
  Synthetic oligonucleotide
aacgaattaagtgttgaccacagcgaccca

SEQ ID NO: 839 - DNA, 19 bp, Artificial
  Synthetic oligonucleotide
gtcatcctgaatgtcctct

SEQ ID NO: 840 - DNA, 19 bp, Artificial
  Synthetic oligonucleotide
atggcccagacgaccccac

SEQ ID NO: 841 - DNA, 18 bp, Artificial
  Synthetic oligonucleotide
catttccccctcatacac

SEQ ID NO: 842 - DNA, 28 bp, Artificial
  Synthetic oligonucleotide
ctattaccgtccaggggtgaacctcagc

SEQ ID NO: 843 - DNA, 22 bp, Artificial
  Synthetic oligonucleotide
cggagctgcccaagccctccat

SEQ ID NO: 844 - DNA, 82 bp, Artificial
  Synthetic oligonucleotide
ctccagcaacaactccaaacccgtggaggacaaggatgctgtggccttcacctgtgaacctgaggctcagaacacaacctac

SEQ ID NO: 845 - DNA, 48 bp, Artificial
  Synthetic oligonucleotide
ctgtggtgggtaaatggtcagagcctcccagtcagtcccaggctgcag

SEQ ID NO: 846 - DNA, 33 bp, Artificial
  Synthetic oligonucleotide
gtaagtggctccctggagcatcagcatcatatt

SEQ ID NO: 847 - DNA, 27 bp, Artificial
  Synthetic oligonucleotide
catctggaacttctcctggtctctcag

SEQ ID NO: 848 - DNA, 92 bp, Artificial
  Synthetic oligonucleotide
ctggggccactgtcggcatcatgattggagtgctggttggggttgctctgatatagcagccctggtgtagtttcttcatttcaggaagactg

SEQ ID NO: 849 - DNA, 26 bp, Artificial
  Synthetic oligonucleotide
acagttgttttgcttcttccttaaag

SEQ ID NO: 850 - DNA, 101 bp, Artificial
  Synthetic oligonucleotide
catttgcaacagctacagtctaaaattgcttctttaccaaggatatttacagaaaagactctgaccagagatcgagaccatcctagccaacatcgtgaaac

SEQ ID NO: 851 - DNA, 34 bp, Artificial
  Synthetic oligonucleotide
cccatctctactaaaaatacaaaaatgagctggg

SEQ ID NO: 852 - DNA, 44 bp, Artificial
  Synthetic oligonucleotide
cttggtggcgcgcacctgtagtcccagttactcgggaggctgag

SEQ ID NO: 853 - DNA, 4 bp, Artificial
  Synthetic oligonucleotide
gcag

SEQ ID NO: 854 - DNA, 88 bp, Artificial
  Synthetic oligonucleotide
gagaatcgcttgaacccgggaggtggagattgcagtgagcccagatcgcaccactgcactccagtctggcaacagagcaagactccat

SEQ ID NO: 855 - DNA, 30 bp, Artificial
  Synthetic oligonucleotide
ataatattttcataattttttatttgaaat

SEQ ID NO: 856 - DNA, 266 bp, Artificial
  Synthetic oligonucleotide
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtag

SEQ ID NO: 857 - DNA, 166 bp, Artificial
  Synthetic oligonucleotide
agtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccag

SEQ ID NO: 858 - DNA, 134 bp, Artificial
  Synthetic oligonucleotide
gggcctacagcgtcagctccggcatccagctgatccgggaggacgtggcgcggtacattgagaggcgtgacggaggcatccctgcggaccccaacaacgtcttcctgtccacaggggccagcgatgccatcgtg

SEQ ID NO: 859 - DNA, 190 bp, Artificial
  Synthetic oligonucleotide
acggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgc

SEQ ID NO: 860 - DNA, 137 bp, Artificial
  Synthetic oligonucleotide
gtgtaccaggacaacgtgtacgccgcgggttcgcagttccactcattcaagaaggtgctcatggagatggggccgccctacgccgggcagcaggagcttgcctccttccactccacctccaagggctacatgggcga

SEQ ID NO: 861 - DNA, 175 bp, Artificial
  Synthetic oligonucleotide
gtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggct

SEQ ID NO: 862 - DNA, 156 bp, Artificial
  Synthetic oligonucleotide
gagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcag

SEQ ID NO: 863 - DNA, 2023 bp, Artificial
  Synthetic oligonucleotide
gagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 864 - DNA, 90 bp, Artificial
  Synthetic oligonucleotide
ggtgtgaagaagcctttcaccgaggtcatccgtgccaacatcggggacgcacaggctatggggcagaggcccatcaccttcctgcgccag

SEQ ID NO: 865 - DNA, 109 bp, Artificial
  Synthetic oligonucleotide
gtcttggccctctgtgttaaccctgatcttctgagcagccccaacttccctgacgatgccaagaaaagggcggagcgcatcttgcaggcgtgtgggggccacagtctgg

SEQ ID NO: 866 - DNA, 54 bp, Artificial
  Synthetic oligonucleotide
gtgaccactgccgccctcgtgcgctctgtgtcatcaaccctggcaaccccaccg

SEQ ID NO: 867 - DNA, 80 bp, Artificial
  Synthetic oligonucleotide
ggcaggtgcagacccgcgagtgcatcgaggccgtgatccgcttcgccttcgaagagcggctctttctgctggcggacgag

SEQ ID NO: 868 - DNA, 67 bp, Artificial
  Synthetic oligonucleotide
gtgcgcggcgcgggggagcgggaagccgggcaacagtccgcccccgtgacgccttgcgcccttccag

SEQ ID NO: 869 - DNA, 100 bp, Artificial
  Synthetic oligonucleotide
gtgcgtgcgtacgaggcgggtgggggctcgcgggccatggccaggccctcctcgcccgatgggccaccccctcctccgcacctgacctggccgtgcgcag

SEQ ID NO: 870 - DNA, 74 bp, Artificial
  Synthetic oligonucleotide
gtcaggcgggggcggggcctgcggggtgggcagggggggccgggcatccctctctgacggctctccgtccacag

SEQ ID NO: 871 - DNA, 73 bp, Artificial
  Synthetic oligonucleotide
gagctgggcctggcccccgatatgttcttctgcctgcgcctcctggaggagaccggcatctgcgtggtgccag

SEQ ID NO: 872 - DNA, 40 bp, Artificial
  Synthetic oligonucleotide
ggagcggctttgggcagcgggaaggcacctaccacttccg

SEQ ID NO: 873 - DNA, 66 bp, Artificial
  Synthetic oligonucleotide
gtgaggcctggccctcactccctgtcccgccaccctggcccttcactcactgtcaactcctttcag

SEQ ID NO: 874 - DNA, 81 bp, Artificial
  Synthetic oligonucleotide
gatgaccattctgccccccttggagaaactgcggctgctgctggagaagctgagcaggttccatgccaagttcaccctcga

SEQ ID NO: 875 - DNA, 57 bp, Artificial
  Synthetic oligonucleotide
gtactcctgagcaccccagctggggccaggctgggtcgccctggactgtgtgctcag

SEQ ID NO: 876 - DNA, 582 bp, Artificial
  Synthetic oligonucleotide
gtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacag

SEQ ID NO: 877 - DNA, 193 bp, Artificial
  Synthetic oligonucleotide
cttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 878 - DNA, 190 bp, Artificial
  Synthetic oligonucleotide
gtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacag

SEQ ID NO: 879 - DNA, 179 bp, Artificial
  Synthetic oligonucleotide
gctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 880 - DNA, 208 bp, Artificial
  Synthetic oligonucleotide
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagt

SEQ ID NO: 881 - DNA, 37 bp, Artificial
  Synthetic oligonucleotide
ccttcaaagctggagtctgtcctcctaagaaatctgc

SEQ ID NO: 882 - DNA, 112 bp, Artificial
  Synthetic oligonucleotide
ccagtgccttagatacaagaaacctgagtgccagagtgactggcagtgtccagggaagaagagatgttgtcctgacacttgtggcatcaaatgcctggatcctgttgacacc

SEQ ID NO: 883 - DNA, 10 bp, Artificial
  Synthetic oligonucleotide
ccaaacccaa

SEQ ID NO: 884 - DNA, 4 bp, Artificial
  Synthetic oligonucleotide
caag

SEQ ID NO: 885 - DNA, 56 bp, Artificial
  Synthetic oligonucleotide
gaggaagcctgggaagtgcccagtgacttatggccaatgtttgatgcttaaccccc

SEQ ID NO: 886 - DNA, 90 bp, Artificial
  Synthetic oligonucleotide
ccaatttctgtgagatggatggccagtgcaagcgtgacttgaagtgttgcatgggcatgtgtgggaaatcctgcgtttcccctgtgaaag

SEQ ID NO: 887 - DNA, 131 bp, Artificial
  Synthetic oligonucleotide
caagcccagcagccccggggcggatggctccggccgcctggctccgcagcgcggccgcgcgcgccctcctgcccccgatgctgctgctgctgctccagccgccgccgctgctggcccgggctctgccgccg

SEQ ID NO: 888 - DNA, 182 bp, Artificial
  Synthetic oligonucleotide
gacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagag

SEQ ID NO: 889 - DNA, 144 bp, Artificial
  Synthetic oligonucleotide
gatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccag

SEQ ID NO: 890 - DNA, 134 bp, Artificial
  Synthetic oligonucleotide
gtactggcatggggacgacctgccgtttgatgggcctgggggcatcctggcccatgccttcttccccaagactcaccgagaaggggatgtccacttcgactatgatgagacctggactatcggggatgaccagg

SEQ ID NO: 891 - DNA, 183 bp, Artificial
  Synthetic oligonucleotide
acaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggag

SEQ ID NO: 892 - DNA, 217 bp, Artificial
  Synthetic oligonucleotide
ccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaag

SEQ ID NO: 893 - DNA, 138 bp, Artificial
  Synthetic oligonucleotide
agctgggatttccatcctcaactggcagagatgagagcctggagcattgcagatgccagggacttcacaaatgaaggcacagcatgggaaacctgcgtgggttccagggcagtccagcctgcaggggcccagggagtg

SEQ ID NO: 894 - DNA, 300 bp, Artificial
  Synthetic oligonucleotide
gtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcag

SEQ ID NO: 895 - DNA, 142 bp, Artificial
  Synthetic oligonucleotide
gtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcag

SEQ ID NO: 896 - DNA, 927 bp, Artificial
  Synthetic oligonucleotide
gtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcag

SEQ ID NO: 897 - DNA, 911 bp, Artificial
  Synthetic oligonucleotide
gctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 898 - DNA, 48 bp, Artificial
  Synthetic oligonucleotide
gttcgtgctttctggcgggcgctgggagaagacggacctcacctacag

SEQ ID NO: 899 - DNA, 41 bp, Artificial
  Synthetic oligonucleotide
gcacagacctgctgcaggtggcagcccatgaatttggccac

SEQ ID NO: 900 - DNA, 18 bp, Artificial
  Synthetic oligonucleotide
gtgctggggctgcagcac

SEQ ID NO: 901 - DNA, 92 bp, Artificial
  Synthetic oligonucleotide
gtgaggccctgcctgccagtccccctactcctctgctggccactgtgactgcagcatatgccctcagcatgtgtccctctctcccaccccag

SEQ ID NO: 902 - DNA, 116 bp, Artificial
  Synthetic oligonucleotide
ggactactggcgtttccaccccagcacccggcgtgtagacagtcccgtgccccgcagggccactgactggagaggggtgccctctgagatcgacgctgccttccaggatgctgatg

SEQ ID NO: 903 - DNA, 359 bp, Artificial
  Synthetic oligonucleotide
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgt

SEQ ID NO: 904 - DNA, 586 bp, Artificial
  Synthetic oligonucleotide
ctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 905 - DNA, 111 bp, Artificial
  Synthetic oligonucleotide
ggaaagtgcatcttcctaagggcgagggtttcagcagtggttgaactcggcggggtggggcggagcgggaggatgcaaacttgcaaagtgaagcaaacacactcaccgcag

SEQ ID NO: 906 - DNA, 44 bp, Artificial
  Synthetic oligonucleotide
cccagcaagggctctggcagctgacagggctttgtctgggacag

SEQ ID NO: 907 - DNA, 97 bp, Artificial
  Synthetic oligonucleotide
ctgcaaaccagtgtgccgtgccagccaaggacagggtggactgcggctacccccatgtcacccccaaggagtgcaacaaccggggctgctgctttga

SEQ ID NO: 908 - DNA, 50 bp, Artificial
  Synthetic oligonucleotide
ctccaggatccctggagtgccttggtgtttcaagcccctgcaggaagcag

SEQ ID NO: 909 - DNA, 19 bp, Artificial
  Synthetic oligonucleotide
aatgcaccttctgaggcac

SEQ ID NO: 910 - DNA, 1133 bp, Artificial
  Synthetic oligonucleotide
tgagacaagatgtcactctgtcacccaggctggagtgcagtggcaggatcacggctcactgcagcctcgacctccctgggctcaggtgatcctcccacctcagcctaccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtagaaaatgtaaaaatagataaatatggagggaagaaatcccccctggaatacagacgcttcctctcccttccagccttttccccatatgaacattgctgtgagtgagacttacatgcaatgtaatttctttttgagcttaacattacaacataaattctcaaactctgatgttcattaaacaccccagccccatcctgggaacttgggcttggggctcggggtgttctgataatgatcaaagtatgagaattgaacccatgaggactttgatccaagatactggggtgtggggaggggcaggcacaggtgtcctgggaacacactttgagaagcaatggcaaagctgggggtccagctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggcattgcgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctggacacacag

SEQ ID NO: 911 - DNA, 790 bp, Artificial
  Synthetic oligonucleotide
ctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcacaaaggtgacgcagatgtgggtgccctgctcctgcccagcagcagtgcttggtggaggctgaggccctgcacaggcaccctcactgctgaccttgagcctctctctcctctag

SEQ ID NO: 912 - DNA, 643 bp, Artificial
  Synthetic oligonucleotide
agtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgatcctggtctcagagaaactggttatttccttaaaacctcagtgtcctctccccacaaaacagaattcactaattaaacttgtcatttcattactcattgcctgcctgcagtggtgagacagatgaagaagacaaggcagtcgataaaaatccatttgttggccatcttctgagtgcccactgagacacagtcccacctttggccgtgtgaatgccaccatgtcctggacccaagggaggctcgggtacacacatccatgtatttattcatctacttcgtaattcatttagtcggtcacgtagccactcattgaacctgggcccctccatctctccaaacagcatgttttcttcaagtaacatact

SEQ ID NO: 913 - DNA, 1298 bp, Artificial
  Synthetic oligonucleotide
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtg

SEQ ID NO: 914 - DNA, 170 bp, Artificial
  Synthetic oligonucleotide
ggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacag

SEQ ID NO: 915 - DNA, 143 bp, Artificial
  Synthetic oligonucleotide
cggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccag

SEQ ID NO: 916 - DNA, 148 bp, Artificial
  Synthetic oligonucleotide
ggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcgg

SEQ ID NO: 917 - DNA, 168 bp, Artificial
  Synthetic oligonucleotide
ctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccag

SEQ ID NO: 918 - DNA, 578 bp, Artificial
  Synthetic oligonucleotide
cagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtc

SEQ ID NO: 919 - DNA, 691 bp, Artificial
  Synthetic oligonucleotide
ggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagaga

SEQ ID NO: 920 - DNA, 131 bp, Artificial
  Synthetic oligonucleotide
ctaaaaatacgaggaaaggagagtgaggattttcattaaaagtctcagcagtgggtttcttgggttatttaaaacatcacctaaataggccttttcttcctaattggccatcaaattaaagcctatccttt

SEQ ID NO: 921 - DNA, 247 bp, Artificial
  Synthetic oligonucleotide
ctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccag

SEQ ID NO: 922 - DNA, 126 bp, Artificial
  Synthetic oligonucleotide
gacacagtttactgatctctgttctagtgagtgggtcaaaaagcatatgcatccttatccgtcaactcatcagctcttcctcaaggcaacctgaggccagacaccaagaaaccaagcgtatctgct

SEQ ID NO: 923 - DNA, 231 bp, Artificial
  Synthetic oligonucleotide
ctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccag

SEQ ID NO: 924 - DNA, 1079 bp, Artificial
  Synthetic oligonucleotide
ctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggct

SEQ ID NO: 925 - DNA, 38 bp, Artificial
  Synthetic oligonucleotide
ggaggaggaggggaagcggcgaaggaggaagaggagga

SEQ ID NO: 926 - DNA, 41 bp, Artificial
  Synthetic oligonucleotide
gagctcccagcagaaaggccgcctgtccctgcagaatacag

SEQ ID NO: 927 - DNA, 11 bp, Artificial
  Synthetic oligonucleotide
ctgcccaggag

SEQ ID NO: 928 - DNA, 53 bp, Artificial
  Synthetic oligonucleotide
aacacccgggtgatagtggagatgatccatttcaaggacttgctgctgcacga

SEQ ID NO: 929 - DNA, 73 bp, Artificial
  Synthetic oligonucleotide
atgctacaagatagaaattactatgcccaagaggaggaaagtgaagctaagagattagagaactcggactgag

SEQ ID NO: 930 - DNA, 33 bp, Artificial
  Synthetic oligonucleotide
accctacgtggacctcgtgaacttgctgctgac

SEQ ID NO: 931 - DNA, 12 bp, Artificial
  Synthetic oligonucleotide
ggcccaccacgg

SEQ ID NO: 932 - DNA, 30 bp, Artificial
  Synthetic oligonucleotide
ggaagcaggacatcacctcccagagcccag

SEQ ID NO: 933 - DNA, 103 bp, Artificial
  Synthetic oligonucleotide
tccgcggaagtcagggcggctggattccaggacaggagtgaatgtaaaaataaatatcgcttagaatgcaggagaagggtggagaggaggcaggggccgaggg

SEQ ID NO: 934 - DNA, 77 bp, Artificial
  Synthetic oligonucleotide
ggtgcttggtgccaaactgaaattcagtttcttgtgtggggccttgcggttcagagctcttggcgagggtggaggga

SEQ ID NO: 935 - DNA, 5 bp, Artificial
  Synthetic oligonucleotide
cagaa

SEQ ID NO: 936 - DNA, 17 bp, Artificial
  Synthetic oligonucleotide
ctgaatttcactcacag

SEQ ID NO: 937 - DNA, 167 bp, Artificial
  Synthetic oligonucleotide
ttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctg

SEQ ID NO: 938 - DNA, 142 bp, Artificial
  Synthetic oligonucleotide
gtcggcaaccacattgatgtgctcactggcaagtgggtggcccaggacgcaggcatcggggctggcgtggactcctactttgagtacttggtgaaaggagccatcctgcttcaggataagaagctcatggccatgttcctag

SEQ ID NO: 939 - DNA, 125 bp, Artificial
  Synthetic oligonucleotide
agtataacaaagccatccggaactacacccgcttcgatgactggtacctgtgggttcagatgtacaaggggactgtgtccatgccagtcttccagtccttggaggcctactggcctggtcttcag

SEQ ID NO: 940 - DNA, 145 bp, Artificial
  Synthetic oligonucleotide
agcctcattggagacattgacaatgccatgaggaccttcctcaactactacactgtatggaagcagtttggggggctcccggaattctacaacattcctcagggatacacagtggagaagcgagagggctacccacttcggccag

SEQ ID NO: 941 - DNA, 172 bp, Artificial
  Synthetic oligonucleotide
aagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaag

SEQ ID NO: 942 - DNA, 375 bp, Artificial
  Synthetic oligonucleotide
ctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 943 - DNA, 122 bp, Artificial
  Synthetic oligonucleotide
aaaagatctcgctctgttgcccaggctggagtgcagtggtgtgatcacgactcaccgcagccttgacctcccacactcaagcaatcctcctgccttagccttccaagtagctggaactccag

SEQ ID NO: 944 - DNA, 105 bp, Artificial
  Synthetic oligonucleotide
ggattcccggaagaacccgcagcagctcccaggatgaactggttgcagtggctgctgctgctgcgggggcgctgagaggacacgagctctatgcctttccggctg

SEQ ID NO: 945 - DNA, 92 bp, Artificial
  Synthetic oligonucleotide
ctcatcccgctcggcctcctgtgcgcgctgctgcctcagcaccatggtgcgccaggtcccgacggctccgcgccagatcccgcccactacag

SEQ ID NO: 946 - DNA, 102 bp, Artificial
  Synthetic oligonucleotide
ggagcgagtcaaggccatgttctaccacgcctacgacagctacctggagaatgcctttcccttcgatgagctgcgacctctcacctgtgacgggcacgacac

SEQ ID NO: 947 - DNA, 9 bp, Artificial
  Synthetic oligonucleotide
ctggggcag

SEQ ID NO: 948 - DNA, 40 bp, Artificial
  Synthetic oligonucleotide
tttttctctgactctaattgatgcactggacaccttgctg

SEQ ID NO: 949 - DNA, 106 bp, Artificial
  Synthetic oligonucleotide
attttggggaatgtctcagaattccaaagagtggttgaagtgctccaggacagcgtggactttgatattgatgtgaacgcctctgtgtttgaaacaaacattcgag

SEQ ID NO: 950 - DNA, 6 bp, Artificial
  Synthetic oligonucleotide
tggtag

SEQ ID NO: 951 - DNA, 27 bp, Artificial
  Synthetic oligonucleotide
gaggactcctgtctgctcatctgctct

SEQ ID NO: 952 - DNA, 93 bp, Artificial
  Synthetic oligonucleotide
ccaagaaggctggggtggaagtagaggctggatggccctgttccgggcctctcctgagaatggctgaggaggcggcccgaaaactcctcccag

SEQ ID NO: 953 - DNA, 35 bp, Artificial
  Synthetic oligonucleotide
cctttcagacccccactggcatgccatatggaaca

SEQ ID NO: 954 - DNA, 10 bp, Artificial
  Synthetic oligonucleotide
gtgaacttac

SEQ ID NO: 955 - DNA, 89 bp, Artificial
  Synthetic oligonucleotide
aacttattgaaagcgcaatgtacctctaccgtgccacgggggatcccaccctcctagaactcggaagagatgctgtggaatccattgaa

SEQ ID NO: 956 - DNA, 33 bp, Artificial
  Synthetic oligonucleotide
aaaatcagcaaggtggagtgcggatttgcaaca

SEQ ID NO: 957 - DNA, 20 bp, Artificial
  Synthetic oligonucleotide
cttgcttccttctcccacat

SEQ ID NO: 958 - DNA, 5 bp, Artificial
  Synthetic oligonucleotide
gtcag

SEQ ID NO: 959 - DNA, 21 bp, Artificial
  Synthetic oligonucleotide
atcaaagatctgcgagaccac

SEQ ID NO: 960 - DNA, 74 bp, Artificial
  Synthetic oligonucleotide
gtggtggttaattttatgtgtcaacctggctggaccactgggtactccgatatttggtcaaacattattctgag

SEQ ID NO: 961 - DNA, 184 bp, Artificial
  Synthetic oligonucleotide
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaag

SEQ ID NO: 962 - DNA, 189 bp, Artificial
  Synthetic oligonucleotide
cactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaa

SEQ ID NO: 963 - DNA, 266 bp, Artificial
  Synthetic oligonucleotide
gtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcag

SEQ ID NO: 964 - DNA, 164 bp, Artificial
  Synthetic oligonucleotide
actgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgag

SEQ ID NO: 965 - DNA, 230 bp, Artificial
  Synthetic oligonucleotide
agtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatc

SEQ ID NO: 966 - DNA, 136 bp, Artificial
  Synthetic oligonucleotide
tggtgtgaataaatcttttatcttgaatgtaataagaatttggtggtgtcaattgcttatttgttttcccacggttgtccagcaattaataaaacataaccttttttactgcctatataatgtttttaaaggttta

SEQ ID NO: 967 - DNA, 26 bp, Artificial
  Synthetic oligonucleotide
gaaaactcactaccatgagaattgca

SEQ ID NO: 968 - DNA, 42 bp, Artificial
  Synthetic oligonucleotide
gtgatttgcttttgcctcctaggcatcacctgtgccatacca

SEQ ID NO: 969 - DNA, 39 bp, Artificial
  Synthetic oligonucleotide
gttaaacaggctgattctggaagttctgaggaaaagcag

SEQ ID NO: 970 - DNA, 87 bp, Artificial
  Synthetic oligonucleotide
gtaagcatcttttatgtttttatatagttaaatcatttactcaattatggcgagaggtgcaagaaacgtatttgctgcgatattact

SEQ ID NO: 971 - DNA, 81 bp, Artificial
  Synthetic oligonucleotide
ctttacaacaaatacccagatgctgtggccacatggctaaaccctgacccatctcagaagcagaatctcctagccccacag

SEQ ID NO: 972 - DNA, 42 bp, Artificial
  Synthetic oligonucleotide
aatgctgtgtcctctgaagaaaccaatgactttaaacaagag

SEQ ID NO: 973 - DNA, 8 bp, Artificial
  Synthetic oligonucleotide
acccttcc

SEQ ID NO: 974 - DNA, 50 bp, Artificial
  Synthetic oligonucleotide
aagtaagtccaacgaaagccatgaccacatggatgatatggatgatgaag

SEQ ID NO: 975 - DNA, 65 bp, Artificial
  Synthetic oligonucleotide
atgatgatgaccatgtggacagccaggactccattgactcgaacgactctgatgatgtagatgac

SEQ ID NO: 976 - DNA, 37 bp, Artificial
  Synthetic oligonucleotide
gtcaaaatctaagaagtttcgcagacctgacatccag

SEQ ID NO: 977 - DNA, 18 bp, Artificial
  Synthetic oligonucleotide
taccctgatgctacagac

SEQ ID NO: 978 - DNA, 26 bp, Artificial
  Synthetic oligonucleotide
gaggacatcacctcacacatggaaag

SEQ ID NO: 979 - DNA, 52 bp, Artificial
  Synthetic oligonucleotide
cgaggagttgaatggtgcatacaaggccatccccgttgcccaggacctgaac

SEQ ID NO: 980 - DNA, 51 bp, Artificial
  Synthetic oligonucleotide
gcgccttctgattgggacagccgtgggaaggacagttatgaaacgagtcag

SEQ ID NO: 981 - DNA, 12 bp, Artificial
  Synthetic oligonucleotide
ctggatgaccag

SEQ ID NO: 982 - DNA, 34 bp, Artificial
  Synthetic oligonucleotide
ttctgaggtcaattaaaaggagaaaaaatacaat

SEQ ID NO: 983 - DNA, 41 bp, Artificial
  Synthetic oligonucleotide
ttctcactttgcatttagtcaaaagaaaaaatgctttatag

SEQ ID NO: 984 - DNA, 36 bp, Artificial
  Synthetic oligonucleotide
caaaatgaaagagaacatgaaatgcttctttctcag

SEQ ID NO: 985 - DNA, 119 bp, Artificial
  Synthetic oligonucleotide
tttattggttgaatgtgtatctatttgagtctggaaataactaatgtgtttgataattagtttagtttgtggcttcatggaaactccctgtaaactaaaagcttcagggttatgtctat

SEQ ID NO: 986 - DNA, 11 bp, Artificial
  Synthetic oligonucleotide
gttcattctat

SEQ ID NO: 987 - DNA, 91 bp, Artificial
  Synthetic oligonucleotide
agaagaaatgcaaactatcactgtattttaatatttgttattctctcatgaatagaaatttatgtagaagcaaacaaaatacttttaccca

SEQ ID NO: 988 - DNA, 18 bp, Artificial
  Synthetic oligonucleotide
cttaaaaagagaatataa

SEQ ID NO: 989 - DNA, 6 bp, Artificial
  Synthetic oligonucleotide
catttt

SEQ ID NO: 990 - DNA, 60 bp, Artificial
  Synthetic oligonucleotide
atgtcactataatcttttgttttttaagttagtgtatattttgttgtgattatctttttg

SEQ ID NO: 991 - DNA, 153 bp, Artificial
  Synthetic oligonucleotide
acactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctccca

SEQ ID NO: 992 - DNA, 744 bp, Artificial
  Synthetic oligonucleotide
ggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 993 - DNA, 174 bp, Artificial
  Synthetic oligonucleotide
gtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactg

SEQ ID NO: 994 - DNA, 309 bp, Artificial
  Synthetic oligonucleotide
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgt

SEQ ID NO: 995 - DNA, 487 bp, Artificial
  Synthetic oligonucleotide
gtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgc

SEQ ID NO: 996 - DNA, 418 bp, Artificial
  Synthetic oligonucleotide
ggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccataaatctggttttgtctttttttgttttaaagaaaaagatgtatacatacagtatagctgcattagataaagcagtgtttgtattttaaaggatgtctgcacaa

SEQ ID NO: 997 - DNA, 44 bp, Artificial
  Synthetic oligonucleotide
gctttgcgctgcaaatccagtgctaccagtgtgaagaattccag

SEQ ID NO: 998 - DNA, 94 bp, Artificial
  Synthetic oligonucleotide
ctgaacaacgactgctcctcccccgagttcattgtgaattgcacggtgaacgttcaagacatgtgtcagaaagaagtgatggagcaaagtgccg

SEQ ID NO: 999 - DNA, 4 bp, Artificial
  Synthetic oligonucleotide
acag

SEQ ID NO: 1000 - DNA, 58 bp, Artificial
  Synthetic oligonucleotide
ggatcatgtaccgcaagtcctgtgcatcatcagcggcctgtctcatcgcctctgccgg

SEQ ID NO: 1001 - DNA, 11 bp, Artificial
  Synthetic oligonucleotide
ctgaagctgaa

SEQ ID NO: 1002 - DNA, 63 bp, Artificial
  Synthetic oligonucleotide
ggagatgccaccccctcctgcattgttcttccagccctcgcccccaaccccccacctccctga

SEQ ID NO: 1003 - DNA, 30 bp, Artificial
  Synthetic oligonucleotide
tctgaaaagtgcttaagaaaatcttctcag

SEQ ID NO: 1004 - DNA, 84 bp, Artificial
  Synthetic oligonucleotide
ttctccttgcagaggactggcgccgggacgcgaagagcaacgggcgctgcacaaagcgggcgctgtcggtggtggagtgcgcat

SEQ ID NO: 1005 - DNA, 26 bp, Artificial
  Synthetic oligonucleotide
gtacgcgcaggcgcttctcgtggttg

SEQ ID NO: 1006 - DNA, 113 bp, Artificial
  Synthetic oligonucleotide
gcgtgctgcagcgacaggcggcagcacagcacctgcacgaacacccgccgaaactgctgcgaggacaccgtgtacaggagcgggttgatgaccgagctgaggtagaaaaacgt

SEQ ID NO: 1007 - DNA, 82 bp, Artificial
  Synthetic oligonucleotide
ctccgagaaggggaggaggatcatgtacgcccggaagtaggacctcgtccagtcgtgcttgggtttggccgcagccatgatc

SEQ ID NO: 1008 - DNA, 24 bp, Artificial
  Synthetic oligonucleotide
ctccgaatctggttgggcatccag

SEQ ID NO: 1009 - DNA, 28 bp, Artificial
  Synthetic oligonucleotide
catacggccaatgtcacaacaatcagcc

SEQ ID NO: 1010 - DNA, 10 bp, Artificial
  Synthetic oligonucleotide
ctccgcggca

SEQ ID NO: 1011 - DNA, 21 bp, Artificial
  Synthetic oligonucleotide
ctgggcagacacgagcaggag

SEQ ID NO: 1012 - DNA, 52 bp, Artificial
  Synthetic oligonucleotide
gcagcgcgggccccagcagcctcggcagccacagccgctgcagccggggcag

SEQ ID NO: 1013 - DNA, 43 bp, Artificial
  Synthetic oligonucleotide
cctccgctgctgtcgcctcctctgatgcgcttgccctctcccg

SEQ ID NO: 1014 - DNA, 32 bp, Artificial
  Synthetic oligonucleotide
gccccgggactccgggagaatgtgggtcctag

SEQ ID NO: 1015 - DNA, 39 bp, Artificial
  Synthetic oligonucleotide
gcatcgcggcaactttttgcggattgttcttgcttccag

SEQ ID NO: 1016 - DNA, 34 bp, Artificial
  Synthetic oligonucleotide
gtgagaatacccagaggccagcagccgaggccag

SEQ ID NO: 1017 - DNA, 438 bp, Artificial
  Synthetic oligonucleotide
gtggaggaggatggtggggagtggtggtgtcttcgtcctgggagaaggcgaagcaacttccaggaggaaacgggcgtttccttcccacgcgctcgagcgagccctgggtcctggcctcggaactccacccagcccctccccaccctctgggaaaagccagtcgccacacacaggcacacgcaggccccggcgccgcgccctaaggagagcagcacccacagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatctacagcgaagaaagtctcgtttggtaaaagcgagaagggaaagc

SEQ ID NO: 1018 - DNA, 122 bp, Artificial
  Synthetic oligonucleotide
gtaatcctgctccctctgctgtttgacctcttctcctgcagctaagtgaagctgcttcctcccttctcttttgtattccccttcccagagggcgataagcaaataataataatgcaataaat

SEQ ID NO: 1019 - DNA, 90 bp, Artificial
  Synthetic oligonucleotide
ctgagcatgcagagtgtgcagagcacgagcttttgtctccgaaagcagtgcctttgcctgaccttcctgcttctccatctcctgggacag

SEQ ID NO: 1020 - DNA, 111 bp, Artificial
  Synthetic oligonucleotide
gtcgctgcgactcagcgctgccctccccagtgcccgggccagtgccctgcgacgccgccgacctgcgcccccggggtgcgcgcggtgctggacggctgctcatgctgtctg

SEQ ID NO: 1021 - DNA, 115 bp, Artificial
  Synthetic oligonucleotide
gtgtgtgcccgccagcgtggcgagagctgctcagatctggagccatgcgacgagagcagtggcctctactgtgatcgcagcgcggaccccagcaaccagactggcatctgcacgg

SEQ ID NO: 1022 - DNA, 232 bp, Artificial; identical to SEQ ID NO: 151
  Synthetic oligonucleotide

SEQ ID NO: 1023 - DNA, 189 bp, Artificial; identical to SEQ ID NO: 152
  Synthetic oligonucleotide

SEQ ID NO: 1024 - DNA, 201 bp, Artificial; identical to SEQ ID NO: 153
  Synthetic oligonucleotide

SEQ ID NO: 1025 - DNA, 698 bp, Artificial; identical to SEQ ID NO: 154
  Synthetic oligonucleotide

SEQ ID NO: 1026 - DNA, 86 bp, Artificial; identical to SEQ ID NO: 155
  Synthetic oligonucleotide

SEQ ID NO: 1027 - DNA, 7 bp, Artificial
  Synthetic oligonucleotide
gataaga

SEQ ID NO: 1028 - DNA, 203 bp, Artificial; identical to SEQ ID NO: 157
  Synthetic oligonucleotide

SEQ ID NO: 1029 - DNA, 229 bp, Artificial; identical to SEQ ID NO: 158
  Synthetic oligonucleotide

SEQ ID NO: 1030 - DNA, 336 bp, Artificial; identical to SEQ ID NO: 159
  Synthetic oligonucleotide

SEQ ID NO: 1031 - DNA, 125 bp, Artificial; identical to SEQ ID NO: 160
  Synthetic oligonucleotide

SEQ ID NO: 1032 - DNA, 1305 bp, Artificial; identical to SEQ ID NO: 161
  Synthetic oligonucleotide

SEQ ID NO: 1033 - DNA, 404 bp, Artificial; identical to SEQ ID NO: 162
  Synthetic oligonucleotide

SEQ ID NO: 1034 - DNA, 184 bp, Artificial; identical to SEQ ID NO: 163
  Synthetic oligonucleotide

SEQ ID NO: 1035 - DNA, 97 bp, Artificial; identical to SEQ ID NO: 164
  Synthetic oligonucleotide

SEQ ID NO: 1036 - DNA, 91 bp, Artificial; identical to SEQ ID NO: 165
  Synthetic oligonucleotide

SEQ ID NO: 1037 - DNA, 65 bp, Artificial; identical to SEQ ID NO: 166
  Synthetic oligonucleotide

SEQ ID NO: 1038 - DNA, 65 bp, Artificial; identical to SEQ ID NO: 167
  Synthetic oligonucleotide

SEQ ID NO: 1039 - DNA, 810 bp, Artificial; identical to SEQ ID NO: 168
  Synthetic oligonucleotide

SEQ ID NO: 1040 - DNA, 168 bp, Artificial; identical to SEQ ID NO: 169
  Synthetic oligonucleotide

SEQ ID NO: 1041 - DNA, 157 bp, Artificial; identical to SEQ ID NO: 170
  Synthetic oligonucleotide

SEQ ID NO: 1042 - DNA, 198 bp, Artificial
  Synthetic oligonucleotide
gtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcag

SEQ ID NO: 1043 - DNA, 153 bp, Artificial; identical to SEQ ID NO: 172
  Synthetic oligonucleotide

SEQ ID NO: 1044 - DNA, 140 bp, Artificial; identical to SEQ ID NO: 173
  Synthetic oligonucleotide

SEQ ID NO: 1045 - DNA, 127 bp, Artificial; identical to SEQ ID NO: 174
  Synthetic oligonucleotide

SEQ ID NO: 1046 - DNA, 223 bp, Artificial; identical to SEQ ID NO: 175
  Synthetic oligonucleotide

SEQ ID NO: 1047 - DNA, 9 bp, Artificial
  Synthetic oligonucleotide
ctgaccaag

SEQ ID NO: 1048 - DNA, 44 bp, Artificial; identical to SEQ ID NO: 177
  Synthetic oligonucleotide

SEQ ID NO: 1049 - DNA, 38 bp, Artificial; identical to SEQ ID NO: 178
  Synthetic oligonucleotide

SEQ ID NO: 1050 - DNA, 14 bp, Artificial
  Synthetic oligonucleotide
ctttgccttccgag

SEQ ID NO: 1051 - DNA, 32 bp, Artificial; identical to SEQ ID NO: 180
  Synthetic oligonucleotide

SEQ ID NO: 1052 - DNA, 24 bp, Artificial
  Synthetic oligonucleotide
gtgaggcctgggtaccccaagctc

SEQ ID NO: 1053 - DNA, 84 bp, Artificial; identical to SEQ ID NO: 182
  Synthetic oligonucleotide

SEQ ID NO: 1054 - DNA, 42 bp, Artificial; identical to SEQ ID NO: 183
  Synthetic oligonucleotide

SEQ ID NO: 1055 - DNA, 51 bp, Artificial; identical to SEQ ID NO: 184
  Synthetic oligonucleotide

SEQ ID NO: 1056 - DNA, 9 bp, Artificial
  Synthetic oligonucleotide
gcatggcac

SEQ ID NO: 1057 - DNA, 95 bp, Artificial; identical to SEQ ID NO: 186
  Synthetic oligonucleotide

SEQ ID NO: 1058 - DNA, 42 bp, Artificial; identical to SEQ ID NO: 187
  Synthetic oligonucleotide

SEQ ID NO: 1059 - DNA, 8 bp, Artificial
  Synthetic oligonucleotide
tcccgccg

SEQ ID NO: 1060 - DNA, 7 bp, Artificial
  Synthetic oligonucleotide
atggccg

SEQ ID NO: 1061 - DNA, 17 bp, Artificial
  Synthetic oligonucleotide
ggccctctgtagctccc

SEQ ID NO: 1062 - DNA, 62 bp, Artificial; identical to SEQ ID NO: 191
  Synthetic oligonucleotide

SEQ ID NO: 1063 - DNA, 20 bp, Artificial
  Synthetic oligonucleotide
agaagtgccagtgtgacgag

SEQ ID NO: 1064 - DNA, 58 bp, Artificial; identical to SEQ ID NO: 193
  Synthetic oligonucleotide

SEQ ID NO: 1065 - DNA, 6 bp, Artificial
  Synthetic oligonucleotide
ctcaag

SEQ ID NO: 1066 - DNA, 20 bp, Artificial
  Synthetic oligonucleotide
gcctgagacccttcatccag

SEQ ID NO: 1067 - DNA, 327 bp, Artificial; identical to SEQ ID NO: 196
  Synthetic oligonucleotide

SEQ ID NO: 1068 - DNA, 177 bp, Artificial; identical to SEQ ID NO: 197
  Synthetic oligonucleotide

SEQ ID NO: 1069 - DNA, 240 bp, Artificial; identical to SEQ ID NO: 198
  Synthetic oligonucleotide

SEQ ID NO: 1070 - DNA, 300 bp, Artificial; identical to SEQ ID NO: 199
  Synthetic oligonucleotide

SEQ ID NO: 1071 - DNA, 152 bp, Artificial; identical to SEQ ID NO: 200
  Synthetic oligonucleotide

SEQ ID NO: 1072 - DNA, 176 bp, Artificial; identical to SEQ ID NO: 201
  Synthetic oligonucleotide

SEQ ID NO: 1073 - DNA, 129 bp, Artificial; identical to SEQ ID NO: 202
  Synthetic oligonucleotide

SEQ ID NO: 1074 - DNA, 279 bp, Artificial; identical to SEQ ID NO: 203
  Synthetic oligonucleotide

SEQ ID NO: 1075 - DNA, 853 bp, Artificial; identical to SEQ ID NO: 280
  Synthetic oligonucleotide

SEQ ID NO: 1076 - DNA, 162 bp, Artificial; identical to SEQ ID NO: 281
  Synthetic oligonucleotide

SEQ ID NO: 1077 - DNA, 130 bp, Artificial; identical to SEQ ID NO: 282
  Synthetic oligonucleotide

SEQ ID NO: 1078 - DNA, 217 bp, Artificial; identical to SEQ ID NO: 283
  Synthetic oligonucleotide

SEQ ID NO: 1079 - DNA, 256 bp, Artificial; identical to SEQ ID NO: 284
  Synthetic oligonucleotide

SEQ ID NO: 1080 - DNA, 176 bp, Artificial; identical to SEQ ID NO: 285
  Synthetic oligonucleotide

SEQ ID NO: 1081 - DNA, 143 bp, Artificial; identical to SEQ ID NO: 286
  Synthetic oligonucleotide

SEQ ID NO: 1082 - DNA, 124 bp, Artificial; identical to SEQ ID NO: 287
  Synthetic oligonucleotide

SEQ ID NO: 1083 - DNA, 588 bp, Artificial; identical to SEQ ID NO: 288
  Synthetic oligonucleotide

SEQ ID NO: 1084 - DNA, 585 bp, Artificial; identical to SEQ ID NO: 289
  Synthetic oligonucleotide

SEQ ID NO: 1085 - DNA, 1188 bp, Artificial; identical to SEQ ID NO: 290
  Synthetic oligonucleotide

SEQ ID NO: 1086 - DNA, 45 bp, Artificial; identical to SEQ ID NO: 291
  Synthetic oligonucleotide

SEQ ID NO: 1087 - DNA, 28 bp, Artificial
  Synthetic oligonucleotide
attattcaaccaggatacctaattcaag

SEQ ID NO: 1088 - DNA, 15 bp, Artificial
  Synthetic oligonucleotide
aacatccgacccaac

SEQ ID NO: 1089 - DNA, 40 bp, Artificial; identical to SEQ ID NO: 294
  Synthetic oligonucleotide

SEQ ID NO: 1090 - DNA, 74 bp, Artificial; identical to SEQ ID NO: 295
  Synthetic oligonucleotide

SEQ ID NO: 1091 - DNA, 96 bp, Artificial; identical to SEQ ID NO: 296
  Synthetic oligonucleotide

SEQ ID NO: 1092 - DNA, 59 bp, Artificial; identical to SEQ ID NO: 297
  Synthetic oligonucleotide

SEQ ID NO: 1093 - DNA, 92 bp, Artificial; identical to SEQ ID NO: 298
  Synthetic oligonucleotide

SEQ ID NO: 1094 - DNA, 57 bp, Artificial; identical to SEQ ID NO: 299
  Synthetic oligonucleotide

SEQ ID NO: 1095 - DNA, 97 bp, Artificial; identical to SEQ ID NO: 300
  Synthetic oligonucleotide

SEQ ID NO: 1096 - DNA, 95 bp, Artificial; identical to SEQ ID NO: 301
  Synthetic oligonucleotide

SEQ ID NO: 1097 - DNA, 66 bp, Artificial; identical to SEQ ID NO: 302
  Synthetic oligonucleotide

SEQ ID NO: 1098 - DNA, 34 bp, Artificial; identical to SEQ ID NO: 303
  Synthetic oligonucleotide

SEQ ID NO: 1099 - DNA, 53 bp, Artificial; identical to SEQ ID NO: 304
  Synthetic oligonucleotide

SEQ ID NO: 1100 - DNA, 95 bp, Artificial; identical to SEQ ID NO: 305
  Synthetic oligonucleotide

SEQ ID NO: 1101 - DNA, 148 bp, Artificial
  Synthetic oligonucleotide
ggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacag

SEQ ID NO: 1102 - DNA, 190 bp, Artificial
  Synthetic oligonucleotide
ataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcag

SEQ ID NO: 1103 - DNA, 194 bp, Artificial
  Synthetic oligonucleotide
atgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaag

SEQ ID NO: 1104 - DNA, 270 bp, Artificial
  Synthetic oligonucleotide
gctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagag

SEQ ID NO: 1105 - DNA, 127 bp, Artificial
  Synthetic oligonucleotide
aaacccatgtatgaagtacagtggaaggttgttgaggagataaatggaaacaattatgtttacatagacccaacacaacttccttatgatcacaaatgggagtttcccagaaacaggctgagttttg

SEQ ID NO: 1106 - DNA, 151 bp, Artificial
  Synthetic oligonucleotide
ggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctg

SEQ ID NO: 1107 - DNA, 125 bp, Artificial
  Synthetic oligonucleotide
gtaaatgcttggctttctgcagtgctgtgctttcaagaatttaatatcctgctcttaattttggatgacatatggatgactgagccatagataaaatatttctggctgggtctagaaggcctaaa

SEQ ID NO: 1108 - DNA, 128 bp, Artificial
  Synthetic oligonucleotide
gctcatacatagaaagagatgtgactcccgccatcatggaggatgacgagttggccctagacttagaagacttgctgagcttttcttaccaggtggcaaagggcatggctttcctcgcctccaagaat

SEQ ID NO: 1109 - DNA, 123 bp, Artificial
  Synthetic oligonucleotide
tgtattcacagagacttggcagccagaaatatcctccttactcatggtcggatcacaaagatttgtgattttggtctagccagagacatcaagaatgattctaattatgtggttaaaggaaac

SEQ ID NO: 1110 - DNA, 1321 bp, Artificial
  Synthetic oligonucleotide
gtgagtacccattctctgcttgacagtcctgcaaaggatttttagtttcaactttcgataaaaattgtttcctgtgactttcataatgtaaatcctgtctagggatatcacacattttagcagtcaaattaagtatacttcagcaaaatttgcatggtatgctgaacattactacaactaacattcaataatagaagtcctaattctaattgtgtaattttggggcatgtgaaggaaacagaaatagccttaattttcattatagcctgagaatagcaatgaacttgattttgctcaagtgtaacaaatgtaggtcattgaaggtcacagcaggagaaattttggggggattggcatgccgtgtgaaaaatattaaaatctaagatcatattcagagttagccatatagaatgttggatcctagaatacacggagagctattaaataggttcataagtaataatgggtttgtagaacatagcaaatgtttttcaaagtgctgtatttccttgccaatttttattgaatcctcagaacaaacccttgtcctataattgcagcaccttcctattttaaaagttggagaaactaaggcatggcatattttagtgctttttatctgaggtgacacaggacaatagaggctgaaactagagcctgtgatttccagagtggcatcccatcgccatggaaaaccatattgccctttataatattctctgcctgtcttcctgggcccatttctgcagtccagatttattcctggaggtggatttttgtgccccttatgataatgtaatgttttccccccatcactgtggcgtctctattggtagcctgtactcgatttggttttgtaagagtgtttctgtgtttatctcctggccaaagcatgaatttctgaaaaggctgccctgaagctagatattatcatcaggagtgataataaaaacaacttctcttcatcctggtgcaattttggaaggaagaatgataagtcgttaattatccagtcctctgaatattgaccaaagggaggaggaagaaggtggccgcctccaggcccagtcttgatgaattctgcaatctgtctccattatttcatgcctgtgtaattttgtcaagagttgtccaatacctctgaatctttgtttttctccccttgggaataatagtgattcctgactcagaaagttatgagttaatatatgtaaagtgcttatgacagtgccagacatattgttactattctttatagatgtcttatttacgatctaaataatcgtgacggtggttacatactgtcttgttattggttagt

SEQ ID NO: 1111 - DNA, 194 bp, Artificial
  Synthetic oligonucleotide
aatgcacttgtgagccatgtatttcagaggtgattgggatcatctgagttcatataggtaaaaggtttttgtgagatggtactcaagttatcactccacatttcagcaacagcagcatctataagaatatcttctgttcaattttgttgagcttctgaattaacattattgactctgttgtgcttctattacag

SEQ ID NO: 1112 - DNA, 1494 bp, Artificial
  Synthetic oligonucleotide
gtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaat

SEQ ID NO: 1113 - DNA, 402 bp, Artificial
  Synthetic oligonucleotide
tttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctag

SEQ ID NO: 1114 - DNA, 282 bp, Artificial
  Synthetic oligonucleotide
atcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccag

SEQ ID NO: 1115 - DNA, 195 bp, Artificial
  Synthetic oligonucleotide
caataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaag

SEQ ID NO: 1116 - DNA, 137 bp, Artificial
  Synthetic oligonucleotide
ccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcag

SEQ ID NO: 1117 - DNA, 169 bp, Artificial
  Synthetic oligonucleotide
actaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtag

SEQ ID NO: 1118 - DNA, 116 bp, Artificial
  Synthetic oligonucleotide
atacgtaagtgaacttcatctaacgagattaaaaggcaccgaaggaggcacttacacattcctagtgtccaattctgacgtcaatgctgccatagcatttaatgtttatgtgaata

SEQ ID NO: 1119 - DNA, 115 bp, Artificial
  Synthetic oligonucleotide
caaaaccagaaatcctgacttacgacaggctcgtgaatggcatgctccaatgtgtggcagcaggattcccagagcccacaatagattggtatttttgtccaggaactgagcagag

SEQ ID NO: 1120 - DNA, 107 bp, Artificial
  Synthetic oligonucleotide
agcaaatccatccccacaccctgttcactcctttgctgattggtttcgtaatcgtagctggcatgatgtgcattattgtgatgattctgacctacaaatatttacag

SEQ ID NO: 1121 - DNA, 105 bp, Artificial
  Synthetic oligonucleotide
ggaaaaccctgggtgctggagctttcgggaaggttgttgaggcaactgcttatggcttaattaagtcagatgcggccatgactgtcgctgtaaagatgctcaagc

SEQ ID NO: 1122 - DNA, 111 bp, Artificial
  Synthetic oligonucleotide
cgagtgcccatttgacagaacgggaagccctcatgtctgaactcaaagtcctgagttaccttggtaatcacatgaatattgtgaatctacttggagcctgcaccattggag

SEQ ID NO: 1123 - DNA, 92 bp, Artificial
  Synthetic oligonucleotide
cagcgatagtactaatgagtacatggacatgaaacctggagtttcttatgttgtcccaaccaaggccgacaaaaggagatctgtgagaatag

SEQ ID NO: 1124 - DNA, 112 bp, Artificial
  Synthetic oligonucleotide
gctcgactacctgtgaagtggatggcacctgaaagcattttcaactgtgtatacacgtttgaaagtgacgtctggtcctatgggatttttctttgggagctgttctctttag

SEQ ID NO: 1125 - DNA, 100 bp, Artificial
  Synthetic oligonucleotide
gaagcagcccctatcctggaatgccggtcgattctaagttctacaagatgatcaaggaaggcttccggatgctcagccctgaacacgcacctgctgaaat

SEQ ID NO: 1126 - DNA, 106 bp, Artificial
  Synthetic oligonucleotide
gtatgacataatgaagacttgctgggatgcagatcccctaaaaagaccaacattcaagcaaattgttcagctaattgagaagcagatttcagagagcaccaatcat

SEQ ID NO: 1127 - DNA, 48 bp, Artificial
  Synthetic oligonucleotide
atttactccaacttagcaaactgcagccccaaccgacagaagcccgtg

SEQ ID NO: 1128 - DNA, 36 bp, Artificial
  Synthetic oligonucleotide
gtacttcaggggcacttcattgagagttttgtcttg

SEQ ID NO: 1129 - DNA, 113 bp, Artificial
  Synthetic oligonucleotide
gatattcttgaaagtttatatttttataattttttcttacatcagatgtttctttgcagtggcttaatgtttgaaattattttgtggctttttttgtaaatattgaaatgtag

SEQ ID NO: 1130 - DNA, 760 bp, Artificial; identical to SEQ ID NO: 335
  Synthetic oligonucleotide

SEQ ID NO: 1131 - DNA, 224 bp, Artificial; identical to SEQ ID NO: 336
  Synthetic oligonucleotide

SEQ ID NO: 1132 - DNA, 359 bp, Artificial; identical to SEQ ID NO: 337
  Synthetic oligonucleotide

SEQ ID NO: 1133 - DNA, 19 bp, Artificial
  Synthetic oligonucleotide
gtaggttcaaaaggcaaag

SEQ ID NO: 1134 - DNA, 14 bp, Artificial
  Synthetic oligonucleotide
actctctgctccag

SEQ ID NO: 1135 - DNA, 178 bp, Artificial; identical to SEQ ID NO: 340
  Synthetic oligonucleotide

SEQ ID NO: 1136 - DNA, 780 bp, Artificial; identical to SEQ ID NO: 341
  Synthetic oligonucleotide

SEQ ID NO: 1137 - DNA, 93 bp, Artificial; identical to SEQ ID NO: 342
  Synthetic oligonucleotide

SEQ ID NO: 1138 - DNA, 6 bp, Artificial
  Synthetic oligonucleotide
attcag

SEQ ID NO: 1139 - DNA, 56 bp, Artificial; identical to SEQ ID NO: 344
  Synthetic oligonucleotide

SEQ ID NO: 1140 - DNA, 115 bp, Artificial; identical to SEQ ID NO: 345
  Synthetic oligonucleotide

SEQ ID NO: 1141 - DNA, 34 bp, Artificial; identical to SEQ ID NO: 346
  Synthetic oligonucleotide

SEQ ID NO: 1142 - DNA, 26 bp, Artificial
  Synthetic oligonucleotide
ctttagcttggaagcaatgttgacaa

SEQ ID NO: 1143 - DNA, 8 bp, Artificial
  Synthetic oligonucleotide
tataccag

SEQ ID NO: 1144 - DNA, 42 bp, Artificial; identical to SEQ ID NO: 349
  Synthetic oligonucleotide

SEQ ID NO: 1145 - DNA, 245 bp, Artificial; identical to SEQ ID NO: 350
  Synthetic oligonucleotide

SEQ ID NO: 1146 - DNA, 161 bp, Artificial; identical to SEQ ID NO: 351
  Synthetic oligonucleotide

SEQ ID NO: 1147 - DNA, 121 bp, Artificial; identical to SEQ ID NO: 352
  Synthetic oligonucleotide

SEQ ID NO: 1148 - DNA, 631 bp, Artificial; identical to SEQ ID NO: 353
  Synthetic oligonucleotide

SEQ ID NO: 1149 - DNA, 150 bp, Artificial; identical to SEQ ID NO: 354
  Synthetic oligonucleotide

SEQ ID NO: 1150 - DNA, 233 bp, Artificial; identical to SEQ ID NO: 355
  Synthetic oligonucleotide

SEQ ID NO: 1151 - DNA, 76 bp, Artificial; identical to SEQ ID NO: 356
  Synthetic oligonucleotide

SEQ ID NO: 1152 - DNA, 119 bp, Artificial; identical to SEQ ID NO: 357
  Synthetic oligonucleotide

SEQ ID NO: 1153 - DNA, 59 bp, Artificial; identical to SEQ ID NO: 358
  Synthetic oligonucleotide

SEQ ID NO: 1154 - DNA, 40 bp, Artificial; identical to SEQ ID NO: 359
  Synthetic oligonucleotide

SEQ ID NO: 1155 - DNA, 51 bp, Artificial; identical to SEQ ID NO: 360
  Synthetic oligonucleotide

SEQ ID NO: 1156 - DNA, 84 bp, Artificial; identical to SEQ ID NO: 361
  Synthetic oligonucleotide

SEQ ID NO: 1157 - DNA, 573 bp, Artificial; identical to SEQ ID NO: 362
  Synthetic oligonucleotide

SEQ ID NO: 1158 - DNA, 387 bp, Artificial; identical to SEQ ID NO: 363
  Synthetic oligonucleotide

SEQ ID NO: 1159 - DNA, 249 bp, Artificial; identical to SEQ ID NO: 364
  Synthetic oligonucleotide

SEQ ID NO: 1160 - DNA, 10 bp, Artificial
  Synthetic oligonucleotide
gtgctggagc

SEQ ID NO: 1161 - DNA, 35 bp, Artificial; identical to SEQ ID NO: 366
  Synthetic oligonucleotide

SEQ ID NO: 1162 - DNA, 21 bp, Artificial
  Synthetic oligonucleotide
tgccacccggacaccaagaag

SEQ ID NO: 1163 - DNA, 92 bp, Artificial; identical to SEQ ID NO: 368
  Synthetic oligonucleotide

SEQ ID NO: 1164 - DNA, 60 bp, Artificial; identical to SEQ ID NO: 370
  Synthetic oligonucleotide

SEQ ID NO: 1165 - DNA, 71 bp, Artificial; identical to SEQ ID NO: 371
  Synthetic oligonucleotide

SEQ ID NO: 1166 - DNA, 70 bp, Artificial; identical to SEQ ID NO: 372
  Synthetic oligonucleotide

SEQ ID NO: 1167 - DNA, 11 bp, Artificial
  Synthetic oligonucleotide
ctcgcctcgca

SEQ ID NO: 1168 - DNA, 24 bp, Artificial
  Synthetic oligonucleotide
ctgctgcctgggctcggcgcgcgg

SEQ ID NO: 1169 - DNA, 7 bp, Artificial
  Synthetic oligonucleotide
gctcttc

SEQ ID NO: 1170 - DNA, 80 bp, Artificial; identical to SEQ ID NO: 376
  Synthetic oligonucleotide

SEQ ID NO: 1171 - DNA, 55 bp, Artificial; identical to SEQ ID NO: 377
  Synthetic oligonucleotide

SEQ ID NO: 1172 - DNA, 213 bp, Artificial; identical to SEQ ID NO: 378
  Synthetic oligonucleotide

SEQ ID NO: 1173 - DNA, 432 bp, Artificial; identical to SEQ ID NO: 379
  Synthetic oligonucleotide

SEQ ID NO: 1174 - DNA, 159 bp, Artificial; identical to SEQ ID NO: 380
  Synthetic oligonucleotide

SEQ ID NO: 1175 - DNA, 139 bp, Artificial; identical to SEQ ID NO: 381
  Synthetic oligonucleotide

SEQ ID NO: 1176 - DNA, 196 bp, Artificial; identical to SEQ ID NO: 382
  Synthetic oligonucleotide

SEQ ID NO: 1177 - DNA, 353 bp, Artificial; identical to SEQ ID NO: 383
  Synthetic oligonucleotide

SEQ ID NO: 1178 - DNA, 590 bp, Artificial; identical to SEQ ID NO: 384
  Synthetic oligonucleotide

SEQ ID NO: 1179 - DNA, 1228 bp, Artificial; identical to SEQ ID NO: 385
  Synthetic oligonucleotide

SEQ ID NO: 1180 - DNA, 326 bp, Artificial; identical to SEQ ID NO: 386
  Synthetic oligonucleotide

SEQ ID NO: 1181 - DNA, 70 bp, Artificial; identical to SEQ ID NO: 387
  Synthetic oligonucleotide

SEQ ID NO: 1182 - DNA, 39 bp, Artificial; identical to SEQ ID NO: 388
  Synthetic oligonucleotide

SEQ ID NO: 1183 - DNA, 79 bp, Artificial; identical to SEQ ID NO: 389
  Synthetic oligonucleotide

SEQ ID NO: 1184 - DNA, 34 bp, Artificial; identical to SEQ ID NO: 390
  Synthetic oligonucleotide

SEQ ID NO: 1185 - DNA, 33 bp, Artificial; identical to SEQ ID NO: 391
  Synthetic oligonucleotide

SEQ ID NO: 1186 - DNA, 39 bp, Artificial; identical to SEQ ID NO: 392
  Synthetic oligonucleotide

SEQ ID NO: 1187 - DNA, 21 bp, Artificial
  Synthetic oligonucleotide
gtggttctgatggctttgtaa

SEQ ID NO: 1188 - DNA, 48 bp, Artificial; identical to SEQ ID NO: 394
  Synthetic oligonucleotide

SEQ ID NO: 1189 - DNA, 38 bp, Artificial; identical to SEQ ID NO: 395
  Synthetic oligonucleotide

SEQ ID NO: 1190 - DNA, 111 bp, Artificial; identical to SEQ ID NO: 396
  Synthetic oligonucleotide

SEQ ID NO: 1191 - DNA, 13 bp, Artificial
  Synthetic oligonucleotide
ctgcgccttctac

SEQ ID NO: 1192 - DNA, 257 bp, Artificial; identical to SEQ ID NO: 398
  Synthetic oligonucleotide

SEQ ID NO: 1193 - DNA, 133 bp, Artificial; identical to SEQ ID NO: 399
  Synthetic oligonucleotide

SEQ ID NO: 1194 - DNA, 1786 bp, Artificial; identical to SEQ ID NO: 400
  Synthetic oligonucleotide

SEQ ID NO: 1195 - DNA, 153 bp, Artificial; identical to SEQ ID NO: 401
  Synthetic oligonucleotide

SEQ ID NO: 1196 - DNA, 110 bp, Artificial; identical to SEQ ID NO: 402
  Synthetic oligonucleotide

SEQ ID NO: 1197 - DNA, 84 bp, Artificial; identical to SEQ ID NO: 403
  Synthetic oligonucleotide

SEQ ID NO: 1198 - DNA, 23 bp, Artificial
  Synthetic oligonucleotide
gtatttatatattatatatttat

SEQ ID NO: 1199 - DNA, 139 bp, Artificial; identical to SEQ ID NO: 405
  Synthetic oligonucleotide

SEQ ID NO: 1200 - DNA, 135 bp, Artificial; identical to SEQ ID NO: 406
  Synthetic oligonucleotide

SEQ ID NO: 1201 - DNA, 163 bp, Artificial; identical to SEQ ID NO: 407
  Synthetic oligonucleotide

SEQ ID NO: 1202 - DNA, 215 bp, Artificial; identical to SEQ ID NO: 408
  Synthetic oligonucleotide

SEQ ID NO: 1203 - DNA, 173 bp, Artificial; identical to SEQ ID NO: 409
  Synthetic oligonucleotide

SEQ ID NO: 1204 - DNA, 1096 bp, Artificial; identical to SEQ ID NO: 410
  Synthetic oligonucleotide

SEQ ID NO: 1205 - DNA, 117 bp, Artificial; identical to SEQ ID NO: 411
  Synthetic oligonucleotide

SEQ ID NO: 1206 - DNA, 110 bp, Artificial; identical to SEQ ID NO: 412
  Synthetic oligonucleotide

SEQ ID NO: 1207 - DNA, 92 bp, Artificial; identical to SEQ ID NO: 413
  Synthetic oligonucleotide

SEQ ID NO: 1208 - DNA, 27 bp, Artificial
  Synthetic oligonucleotide
cagaaaattaatgaagtttcttcttct

SEQ ID NO: 1209 - DNA, 72 bp, Artificial; identical to SEQ ID NO: 415
  Synthetic oligonucleotide

SEQ ID NO: 1210 - DNA, 82 bp, Artificial; identical to SEQ ID NO: 416
  Synthetic oligonucleotide

SEQ ID NO: 1211 - DNA, 56 bp, Artificial; identical to SEQ ID NO: 417
  Synthetic oligonucleotide

SEQ ID NO: 1212 - DNA, 84 bp, Artificial; identical to SEQ ID NO: 418
  Synthetic oligonucleotide

SEQ ID NO: 1213 - DNA, 113 bp, Artificial; identical to SEQ ID NO: 419
  Synthetic oligonucleotide

SEQ ID NO: 1214 - DNA, 55 bp, Artificial; identical to SEQ ID NO: 420
  Synthetic oligonucleotide

SEQ ID NO: 1215 - DNA, 94 bp, Artificial; identical to SEQ ID NO: 421
  Synthetic oligonucleotide

SEQ ID NO: 1216 - DNA, 271 bp, Artificial; identical to SEQ ID NO: 422
  Synthetic oligonucleotide

SEQ ID NO: 1217 - DNA, 172 bp, Artificial; identical to SEQ ID NO: 423
  Synthetic oligonucleotide

SEQ ID NO: 1218 - DNA, 77 bp, Artificial; identical to SEQ ID NO: 424
  Synthetic oligonucleotide

SEQ ID NO: 1219 - DNA, 115 bp, Artificial; identical to SEQ ID NO: 425
  Synthetic oligonucleotide

SEQ ID NO: 1220 - DNA, 25 bp, Artificial
  Synthetic oligonucleotide
ctgtcccggaaggagaagctgagat

SEQ ID NO: 1221 - DNA, 62 bp, Artificial; identical to SEQ ID NO: 427
  Synthetic oligonucleotide

SEQ ID NO: 1222 - DNA, 108 bp, Artificial; identical to SEQ ID NO: 428
  Synthetic oligonucleotide

SEQ ID NO: 1223 - DNA, 48 bp, Artificial; identical to SEQ ID NO: 429
  Synthetic oligonucleotide

SEQ ID NO: 1224 - DNA, 9 bp, Artificial
  Synthetic oligonucleotide
atctggcag

SEQ ID NO: 1225 - DNA, 108 bp, Artificial; identical to SEQ ID NO: 431
  Synthetic oligonucleotide

SEQ ID NO: 1226 - DNA, 70 bp, Artificial; identical to SEQ ID NO: 432
  Synthetic oligonucleotide

SEQ ID NO: 1227 - DNA, 4 bp, Artificial
  Synthetic oligonucleotide
caag

SEQ ID NO: 1228 - DNA, 157 bp, Artificial; identical to SEQ ID NO: 434
  Synthetic oligonucleotide

SEQ ID NO: 1229 - DNA, 137 bp, Artificial; identical to SEQ ID NO: 435
  Synthetic oligonucleotide

SEQ ID NO: 1230 - DNA, 436 bp, Artificial; identical to SEQ ID NO: 436
  Synthetic oligonucleotide

SEQ ID NO: 1231 - DNA, 669 bp, Artificial; identical to SEQ ID NO: 437
  Synthetic oligonucleotide

SEQ ID NO: 1232 - DNA, 33 bp, Artificial; identical to SEQ ID NO: 438
  Synthetic oligonucleotide

SEQ ID NO: 1233 - DNA, 75 bp, Artificial; identical to SEQ ID NO: 439
  Synthetic oligonucleotide

SEQ ID NO: 1234 - DNA, 616 bp, Artificial; identical to SEQ ID NO: 440
  Synthetic oligonucleotide

SEQ ID NO: 1235 - DNA, 1062 bp, Artificial; identical to SEQ ID NO: 441
  Synthetic oligonucleotide

SEQ ID NO: 1236 - DNA, 261 bp, Artificial; identical to SEQ ID NO: 442
  Synthetic oligonucleotide

SEQ ID NO: 1237 - DNA, 1361 bp, Artificial; identical to SEQ ID NO: 443
  Synthetic oligonucleotide

SEQ ID NO: 1238 - DNA, 569 bp, Artificial; identical to SEQ ID NO: 444
  Synthetic oligonucleotide

SEQ ID NO: 1239 - DNA, 163 bp, Artificial; identical to SEQ ID NO: 445
  Synthetic oligonucleotide

SEQ ID NO: 1240 - DNA, 81 bp, Artificial; identical to SEQ ID NO: 446
  Synthetic oligonucleotide

SEQ ID NO: 1241 - DNA, 56 bp, Artificial; identical to SEQ ID NO: 447
  Synthetic oligonucleotide

SEQ ID NO: 1242 - DNA, 17 bp, Artificial
  Synthetic oligonucleotide
actctgtcaccctccag

SEQ ID NO: 1243 - DNA, 81 bp, Artificial; identical to SEQ ID NO: 449
  Synthetic oligonucleotide

SEQ ID NO: 1244 - DNA, 20 bp, Artificial
  Synthetic oligonucleotide
ttaaaaaaaaaaaaaaaaaa

SEQ ID NO: 1245 - DNA, 108 bp, Artificial; identical to SEQ ID NO: 451
  Synthetic oligonucleotide

SEQ ID NO: 1246 - DNA, 40 bp, Artificial; identical to SEQ ID NO: 452
  Synthetic oligonucleotide

SEQ ID NO: 1247 - DNA, 23 bp, Artificial
  Synthetic oligonucleotide
cttaggagaaaacttaaaaatat

SEQ ID NO: 1248 - DNA, 53 bp, Artificial; identical to SEQ ID NO: 454
  Synthetic oligonucleotide

SEQ ID NO: 1249 - DNA, 54 bp, Artificial; identical to SEQ ID NO: 455
  Synthetic oligonucleotide

SEQ ID NO: 1250 - DNA, 103 bp, Artificial; identical to SEQ ID NO: 456
  Synthetic oligonucleotide

SEQ ID NO: 1251 - DNA, 36 bp, Artificial; identical to SEQ ID NO: 457
  Synthetic oligonucleotide

SEQ ID NO: 1252 - DNA, 34 bp, Artificial; identical to SEQ ID NO: 458
  Synthetic oligonucleotide

SEQ ID NO: 1253 - DNA, 106 bp, Artificial; identical to SEQ ID NO: 459
  Synthetic oligonucleotide

SEQ ID NO: 1254 - DNA, 58 bp, Artificial; identical to SEQ ID NO: 460
  Synthetic oligonucleotide

SEQ ID NO: 1255 - DNA, 669 bp, Artificial; identical to SEQ ID NO: 461
  Synthetic oligonucleotide

SEQ ID NO: 1256 - DNA, 187 bp, Artificial; identical to SEQ ID NO: 462
  Synthetic oligonucleotide

SEQ ID NO: 1257 - DNA, 172 bp, Artificial; identical to SEQ ID NO: 463
  Synthetic oligonucleotide

SEQ ID NO: 1258 - DNA, 275 bp, Artificial; identical to SEQ ID NO: 464
  Synthetic oligonucleotide

SEQ ID NO: 1259 - DNA, 1685 bp, Artificial; identical to SEQ ID NO: 465
  Synthetic oligonucleotide

SEQ ID NO: 1260 - DNA, 877 bp, Artificial; identical to SEQ ID NO: 466
  Synthetic oligonucleotide

SEQ ID NO: 1261 - DNA, 252 bp, Artificial; identical to SEQ ID NO: 467
  Synthetic oligonucleotide

SEQ ID NO: 1262 - DNA, 349 bp, Artificial; identical to SEQ ID NO: 468
  Synthetic oligonucleotide

SEQ ID NO: 1263 - DNA, 233 bp, Artificial; identical to SEQ ID NO: 469
  Synthetic oligonucleotide

SEQ ID NO: 1264 - DNA, 51 bp, Artificial; identical to SEQ ID NO: 470
  Synthetic oligonucleotide

SEQ ID NO: 1265 - DNA, 75 bp, Artificial; identical to SEQ ID NO: 471
  Synthetic oligonucleotide

SEQ ID NO: 1266 - DNA, 83 bp, Artificial; identical to SEQ ID NO: 472
  Synthetic oligonucleotide

SEQ ID NO: 1267 - DNA, 103 bp, Artificial; identical to SEQ ID NO: 473
  Synthetic oligonucleotide

SEQ ID NO: 1268 - DNA, 95 bp, Artificial; identical to SEQ ID NO: 474
  Synthetic oligonucleotide

SEQ ID NO: 1269 - DNA, 38 bp, Artificial; identical to SEQ ID NO: 475
  Synthetic oligonucleotide

SEQ ID NO: 1270 - DNA, 75 bp, Artificial; identical to SEQ ID NO: 476
  Synthetic oligonucleotide

SEQ ID NO: 1271 - DNA, 19 bp, Artificial
  Synthetic oligonucleotide
cttactgaaggtacagccg

SEQ ID NO: 1272 - DNA, 65 bp, Artificial; identical to SEQ ID NO: 478
  Synthetic oligonucleotide

SEQ ID NO: 1273 - DNA, 107 bp, Artificial; identical to SEQ ID NO: 479
  Synthetic oligonucleotide

SEQ ID NO: 1274 - DNA, 100 bp, Artificial; identical to SEQ ID NO: 480
  Synthetic oligonucleotide

SEQ ID NO: 1275 - DNA, 48 bp, Artificial; identical to SEQ ID NO: 481
  Synthetic oligonucleotide

SEQ ID NO: 1276 - DNA, 126 bp, Artificial
  Synthetic oligonucleotide
gtgctcacctccacagcggcttccttgatccttgccacccgcgactgaacaccgacagcagcagcctcaccatgaagttgctgatggtcctcatgctggcggccctctcccagcactgctacgcag

SEQ ID NO: 1277 - DNA, 179 bp, Artificial
  Synthetic oligonucleotide
gctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgag

SEQ ID NO: 1278 - DNA, 593 bp, Artificial
  Synthetic oligonucleotide
gtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattt

SEQ ID NO: 1279 - DNA, 211 bp, Artificial
  Synthetic oligonucleotide
caattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaaaaaaaaaat

SEQ ID NO: 1280 - DNA, 9 bp, Artificial
  Synthetic oligonucleotide
gtgtttatg

SEQ ID NO: 1281 - protein, 152 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGDCGFPAFRELKRAETVSPVFFTRRCIWEDLKSTGFSPAGGGRPPGGGPRTQEDSGLPCWRSSCSVTLQV

SEQ ID NO: 1282 - protein, 83 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVG

SEQ ID NO: 1283 - protein, 496 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKVPIGWVLSPSPTSLRAPLPG

SEQ ID NO: 1284 - protein, 301 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRERQDLTMLSRLVLNSWPQMILPPQPPKVLEL

SEQ ID NO: 1285 - protein, 283 aa, Homo sapiens [sequence omitted]

SEQ ID NO: 1286 - protein, 447 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 1287 - protein, 363 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSDKYYRVNLRTRRVDTVDPPYPRSIAQYWLGCPAPGHL

SEQ ID NO: 1288 - protein, 238 aa, Homo sapiens [sequence omitted]

SEQ ID NO: 1289 - protein, 790 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNPHKYSAHGRTRHFESATRTTNGAQKLSRI

SEQ ID NO: 1290 - protein, 791 aa, Homo sapiens
MKYSCCALVLAVLGTELLGSLCSTVRSPRFRGRIQQERKNIRPNIILVLTDDQDVELAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1291 - protein, 416 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERG

SEQ ID NO: 1292 - protein, 410 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRCVIVPPLSQPQIH

SEQ ID NO: 1293 - protein, 210 aa, Homo sapiens [sequence omitted]

SEQ ID NO: 1294 - protein, 145 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTGLLHRLNH

SEQ ID NO: 1295 - DNA, 21 bp, Artificial
  Synthetic oligonucleotide
tgacactggcaaaacaatgca

SEQ ID NO: 1296 - DNA, 21 bp, Artificial
  Synthetic oligonucleotide
ggtccttttcaccagcaagct

SEQ ID NO: 1297 - DNA, 94 bp, Artificial
  Synthetic oligonucleotide
tgacactggcaaaacaatgcagactttgctttccttggtcaggcagtataatccaaagatggtcaaggtcgcaagcttgctggtgaaaaggacc

SEQ ID NO: 1298 - DNA, 23 bp, Artificial
  Synthetic oligonucleotide
tggcaagaagaaggtctggttag

SEQ ID NO: 1299 - protein, 141 aa, Homo sapiens [sequence omitted]

SEQ ID NO: 1300 - protein, 142 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKDSLLQVLNVKEGTPS

SEQ ID NO: 1301 - protein, 201 aa, Homo sapiens
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWEARWLTPVIPALWEAETGGSRGQEMETIPANTLIQEDILDTGNDKNGKEEVIKRKIPYILKRQLYENKPRRPYILKRDSYYY

SEQ ID NO: 1302 - protein, 168 aa, Homo sapiens
MMAGMKIQLVCMLLLAFSSWSLCSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 1303 - protein, 95 aa, Homo sapiens
MMAGMKIQLVCMLLLAFSSWSLCSDSEEEMKALEADFLTNMHTSKLIQEDILDTGNDKNGKEEVIKRKIPYILKRQLYENKPRRPYILKRDSYYY

SEQ ID NO: 1304 - protein, 33 aa, Homo sapiens
MKLVSVALMYLGSLAFLGADTARLDVASEFRKK

SEQ ID NO: 1305 - protein, 83 aa, Homo sapiens
MKLVSVALMYLGSLAFLGADTARLDVASEFRKKWNKWALSRGKRELRMSSSYPTGLADVKAGPAQTLIRPQDMKGASRSPEDR

SEQ ID NO: 1306 - protein, 180 aa, Homo sapiens [sequence omitted]

SEQ ID NO: 1307 - protein, 381 aa, Homo sapiens [sequence omitted]

SEQ ID NO: 1308 - protein, 385 aa, Homo sapiens [sequence omitted]

SEQ ID NO: 1309 - protein, 81 aa, Homo sapiens
MSLLSSRAARVPGPSSSLCALLVLLLLLTQPGPIASAGPAAAVLRELRCVCLQTTQGVHPKMISNLQVFAIGPQCSKVEVV

SEQ ID NO: 1310 - protein, 340 aa, Homo sapiens
MKSLTATSSMKVLLPRTFWTRKLMKFLLLLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 1311 - protein, 238 aa, Homo sapiens
MAEKALLCPSSAGLGTWPWVLNSAWPVLPLAVDQGVDWRPRGPVSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 1312 - protein, 80 aa, Homo sapiens
MRILQLILLALATGLVGGETRIIKGFECKPHSQPWQAALFEKTRLLCGATLIAPRWLLTAAHCLKPTPASHLAMRQHHHH

SEQ ID NO: 1313 - protein, 123 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRYAPPLLTFLPTRPSCGSQDGKGPPHQVI

SEQ ID NO: 1314 - protein, 464 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQDAMVVSSRPKATTHRKSRTLSRR

SEQ ID NO: 1315 - protein, 434 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHRSKRNL

SEQ ID NO: 1316 - protein, 454 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQLLWLRGKVSFYCF

SEQ ID NO: 1317 - protein, 429 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 1318 - protein, 314 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 1319 - protein, 326 aa, Homo sapiens
HTREGTLGGQKRAFPDGVEGEKGRGRAWGAASRGSAVPLTIRGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 1320 - protein, 213 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGSSGRHHKQLYVQPPLPQVQFPQGHLWRHG

SEQ ID NO: 1321 - protein, 307 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGCCLSPSHYRPHSTAISPHPPGSSGRHHKQLYVQPPLPQVQFPQGHLWRHGLCWQCPRREGCLLRECPCHHSQPRKASCVPVPYLTLMPTPGGGDCCPTLQMQKRRLGCCQGEEEDVHPVYPAP

SEQ ID NO: 1322 - protein, 265 aa, Homo sapiens
HTREGTLGGQKRAFPDGVEGEKGRGRAWGAASRGSAVPLTIRGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFVSVPATTPSPGKHPVSLCLI

SEQ ID NO: 1323 - protein, 188 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEDKRTQ

SEQ ID NO: 1324 - protein, 354 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITGEGHSLPISPGVLQTQNCGP

SEQ ID NO: 1325 - protein, 352 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITAFCQLIYPGKGRTRARMF

SEQ ID NO: 1326 - protein, 363 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVENSPTPRLLPNMGGAPGRCPRPSLGAWRGASCWC

SEQ ID NO: 1327 - protein, 398 aa, Homo sapiens
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 1328 - protein, 432 aa, Homo sapiens [sequence omitted]

SEQ ID NO: 1329 - protein, 52 aa, Homo sapiens
MALFGALFLALLAGAHAEFPGRGCAFWSKSWRLSPFRTCGAKKATSTTTSLR

SEQ ID NO: 1330 - protein, 98 aa, Homo sapiens
MALFGALFLALLAGAHAEFPGCKIRVTSKALELVKQEGLRFLEQELETITIPDLRGKEGHFYYNISEPGLERGADKFPVVGGSSLFLALDLTLRPPVG

SEQ ID NO: 1331 - protein, 200 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQVWAATGRRVARVGMLSL

SEQ ID NO: 1332 - protein, 217 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVLWTSLLALTIPS

SEQ ID NO: 1333 - protein, 148 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQVWAATGRRVARVGMLSL

SEQ ID NO: 1334 - protein, 258 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 1335 - protein, 140 aa, Homo sapiens [sequence omitted]

SEQ ID NO: 1336 - protein, 919 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1337 - protein, 907 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1338 - protein, 212 aa, Homo sapiens
PELRQPARLGLPECWDYRHEPRCPAQMGSHFIVQAGLKLLASSKPPKCWDYRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1339 - protein, 812 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKVRKSW

SEQ ID NO: 1340 - protein, 107 aa, Homo sapiens
MGKRRHRPRVSLAVCGPPLATLSWLAGCRSASFSGWPACCSGLGCLTITPSQGSAGHCERWLPGQCSSVWTVPQARAHQLGSCPEGWDLSGSCAGQSGELLVCGGKL

SEQ ID NO: 1341 - protein, 725 aa, Homo sapiens
MATYIHVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1342 - protein, 674 aa, Homo sapiens
MTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1343 - protein, 593 aa, Homo sapiens
MELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1344 - protein, 239 aa, Homo sapiens [sequence omitted]

SEQ ID NO: 1345 - protein, 737 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRE

SEQ ID NO: 1346 - protein, 514 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDEVKNAIYFFFHKVLLLLFVVDVCSRNLIGIEAFHNYRIMWKFLGRCPFTASYKLIITEFRK

SEQ ID NO: 1347 - protein, 125 aa, Homo sapiens
MTQNFRLMWNILLFPLNFSLNQKLQLEQEKLSSDYNKLKIEDQEREMKLEKLLLLNDKREQAREDLKGLEETVSRELQTLHNLRKLFVQDLTTRVKKVSSLCLNGTEKKIKDGREESFSVEISLA

SEQ ID NO: 1348 - protein, 385 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNDFLAAHVFGKLLE

SEQ ID NO: 1349 - protein, 324 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRV

SEQ ID NO: 1350 - protein, 519 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDGE

SEQ ID NO: 1351 - protein, 541 aa, Homo sapiens [sequence omitted]

SEQ ID NO: 1352 - protein, 544 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGECVCSKGFPFPLIGDSEG

SEQ ID NO: 1353 - protein, 619 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELVRGGTAGYLGEETRGQRPGCDSQSHTGPSKKPSAPSPLPAGTSWDRGVP

SEQ ID NO: 1354 - protein, 597 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 1355 - protein, 498 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIRECLLPWLPLQISEGRS

SEQ ID NO: 1356 - protein, 588 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVLTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 1357 - protein, 505 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQPQNPNSQPRAAGSLEVIISHPFVRRLEILISPFQFQNSIPKNSQIVPAASPRGTSSP

SEQ ID NO: 1358 - protein, 62 aa, Homo sapiens
MPASARLAGAGLLLAFLRALGCAGRAPGLSMAEGNTLISVDYEIFGKVQGVFFRKHTQLFTI

SEQ ID NO: 1359 - protein, 64 aa, Homo sapiens
SGRGGLRALVSRWRGGPGVILAAGGEDKEGLSMAEGNTLISVDYEIFGKVQGVFFRKHTQLFTI

SEQ ID NO: 1360 - protein, 129 aa, Homo sapiens
MPASARLAGAGLLLAFLRALGCAGRAPGLSMAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 1361 - protein, 73 aa, Homo sapiens
MQAEGKKLGLVGWVQNTDRGTVQGQLQGPISKVRHMQEWLETRGSPKSHIDKANFNNEKVILKLDYSDFQIVK

SEQ ID NO: 1362 - protein, 87 aa, Homo sapiens
SGRGGLRALVSRWRGGPGVILAAGGEDKEGLSMAEGNTLISVDYEIFGKVQGVFFRKHTQEMTVENRIAETHSKSCVPVSFATSYAG

SEQ ID NO: 1363 - protein, 80 aa, Homo sapiens
SGRGGLRALVSRWRGGPGVILAAGGEDKEGLSMAEGNTLISVDYEIFGKVQGVFFRKHTQLCFWEAEEGGSFEPGRLRLQ

SEQ ID NO: 1364 - protein, 94 aa, Homo sapiens
SGRGGLRALVSRWRGGPGVILAAGGEDKEGLSMAEGNTLISVDYEIFGKVQGVFFRKHTQEMTVENRIAETHSKSCVPVSFATSYAGINEFKRI

SEQ ID NO: 1365 - protein, 69 aa, Homo sapiens
SGRGGLRALVSRWRGGPGVILAAGGEDKEGLSMAEGNTLISVDYEIFGKVQGVFFRKHTQVCGLQALGW

SEQ ID NO: 1366 - protein, 85 aa, Homo sapiens
MPASARLAGAGLLLAFLRALGCAGRAPGLSMAEGNTLISVDYEIFGKVQGVFFRKHTQEMTVENRIAETHSKSCVPVSFATSYAG

SEQ ID NO: 1367 - protein, 78 aa, Homo sapiens
MPASARLAGAGLLLAFLRALGCAGRAPGLSMAEGNTLISVDYEIFGKVQGVFFRKHTQLCFWEAEEGGSFEPGRLRLQ

SEQ ID NO: 1368 - protein, 92 aa, Homo sapiens
MPASARLAGAGLLLAFLRALGCAGRAPGLSMAEGNTLISVDYEIFGKVQGVFFRKHTQEMTVENRIAETHSKSCVPVSFATSYAGINEFKRI

SEQ ID NO: 1369 - protein, 67 aa, Homo sapiens
MPASARLAGAGLLLAFLRALGCAGRAPGLSMAEGNTLISVDYEIFGKVQGVFFRKHTQVCGLQALGW

SEQ ID NO: 1370 - protein, 1305 aa, Homo sapiens
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1371 - protein, 246 aa, Homo sapiens
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMEVGLGRGLGDSEWVRGCVCHHAQHREILDGNRVASAVEDEGAEVDGEAFRWGSLWVGESWDM

SEQ ID NO: 1372 - protein, 1081 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVVSMMIINSQTIMVVNYSSSFITLML

SEQ ID NO: 1373 - protein, 729 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKMCCNLSFGILIPLQK

SEQ ID NO: 1374 - protein, 738 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGMAGVDGPPGPKGNMGPQGEPGPPGQQGNPGPQGLPGPQGPIGPPGEKVSFSFSLFYKKVIKFACDKRFVGRHDERKVVKLSLPLYLIYE

SEQ ID NO: 1375 - protein, 273 aa, Homo sapiens [sequence omitted]

SEQ ID NO: 1376 - protein, 154 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 1377 - protein, 99 aa, Homo sapiens
MKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 1378 - protein, 135 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKG

SEQ ID NO: 1379 - protein, 154 aa, Homo sapiens; identical to SEQ ID NO: 1376

SEQ ID NO: 1380 - protein, 315 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLCEYICSSLAQAASPNPQGQRQDFSVPLRFKYTDPQPWTSRLSVTFCPRKTWADQVLTKNRRGGAASVLGGSGSTPYDGRNR

SEQ ID NO: 1381 - protein, 719 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSGKWLPGASASYSGVESIWFSPKSQEDIFFPSLCSMGTRKSQILS

SEQ ID NO: 1382 - protein, 569 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSNPVEDKDAVAFTCEPEVQNTTYLWWVNGQSLPVSPRLQLSNGNMTLTLLSCQKERCRIL

SEQ ID NO: 1383 - protein, 346 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 1384 - protein, 346 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 1385 - protein, 385 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVRGAGEREAGQQSAPVTPCALPGVPGQRVRRGFAVPLIQEGAHGDGAALRRAAGACLLPLHLQGLHGRVRAYEAGGGSRAMARPSSPDGPPPPPHLTWPCAGAGSAAAMWRW

SEQ ID NO: 1386 - protein, 346 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECVRTRRVGARGPWPGPPRPMGHPLLRT

SEQ ID NO: 1387 - protein, 271 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARSGFGQREGTYHFRMTILPPLEKLRLLLEKLSRFHAKFTLEYS

SEQ ID NO: 1388 - protein, 399 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVRGAGEREAGQQSAPVTPCALPGVPGQRVRRGFAVPLIQEGAHGDGAALRRAAGACLLPLHLQGLHGRVRVPRRLCGGGEHGRCSAAADAEADECAAVPAGARTGPAGPGGQPARAHRPLLCAVPG

SEQ ID NO: 1389 - protein, 555 aa, Homo sapiens [sequence omitted]

SEQ ID NO: 1390 - protein, 139 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGKQGMRAH

SEQ ID NO: 1391 - protein, 156 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGEKRHHKQLRDQEVDPLEMRRHSAG

SEQ ID NO: 1392 - protein, 89 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPRGSLGSAQ

SEQ ID NO: 1393 - protein, 82 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPT

SEQ ID NO: 1394 - protein, 496 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGALGVRQLVGGGHSSRFSHLVVAGLPHACHRKSGSSSQVLCPEPSALLSVAG

SEQ ID NO: 1395 - protein, 382 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQELGFPSSTGRDESLEHCRCQGLHK

SEQ ID NO: 1396 - protein, 370 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 1397 - protein, 301 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEVRPCLPVPLLLCWPL

SEQ ID NO: 1398 - protein, 354 aa, Homo sapiens [sequence omitted]

SEQ ID NO: 1399 - protein, 137 aa, Homo sapiens
MAARALCMLGLVLALLSSSSAEEYVGLSQQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 1400 - protein, 41 aa, Homo sapiens [sequence omitted]

SEQ ID NO: 1401 - protein, 159 aa, Homo sapiens
MHTVVSWSDDMFLPILIVFLSTWTHSSLAQGWVISTPCCCCSDLHPGPAWSHSENALLSHGQALRALPAWPSQRRPESLGPKQRGRTGLRVLAPCSLHTWGSTLAFPGSLCDFRAGPLGPLGLIIFICNRAMPLPCLVVLRSSCLCKQLVQCQHEMGGP

SEQ ID NO: 1402 - protein, 187 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHECYKIEITMPKRRKVKLRD

SEQ ID NO: 1403 - protein, 449 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATLASFSHMSDQRSARPQAGQPHGVVLPGRDCEIPLPPV

SEQ ID NO: 1404 - protein, 341 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQNLLKAQCTSTVPRGIPPS

SEQ ID NO: 1405 - protein, 287 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEPHWRH

SEQ ID NO: 1406 - protein, 433 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATKRSRSVAQAGVQWCDHDSPQP

SEQ ID NO: 1407 - protein, 418 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIREYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 1408 - protein, 60 aa, Homo sapiens
MPFRLLIPLGLLCALLPQHHGAPGPDGSAPDPAHYRFWGMSQNSKEWLKCSRTAWTLILM

SEQ ID NO: 1409 - protein, 112 aa, Homo sapiens
MYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1410 - protein, 222 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1411 - protein, 93 aa, Homo sapiens
MWVLGIAATFCGLFLLPGFALQIQCYQCEEFQLNNDCSSPEFIVNCTVNVQDMCQKEVMEQSAGSHCVTRLECSGTISAHCNLCLPGSNDHPT

SEQ ID NO: 1412 - protein, 84 aa, Homo sapiens
MWVLGIAATFCGLFLLPGFALQIQCYQCEEFQLNNDCSSPEFIVNCTVNVQDMCQKEVMEQSADTKRTNTLLFEMRHFAKQLTT

SEQ ID NO: 1413 - protein, 90 aa, Homo sapiens
MWVLGIAATFCGLFLLPGFALQIQCYQCEEFQLNNDCSSPEFIVNCTVNVQDMCQKEVMEQSADRVSLCHEAGVQWNNFSTLQPLPPRLK

SEQ ID NO: 1414 - protein, 111 aa, Homo sapiens
MQSVQSTSFCLRKQCLCLTFLLLHLLGQVAATQRCPPQCPGQCPATPPTCAPGVRAVLDGCSCCLVCARQRGESCSDLEPCDESSGLYCDRSADPSNQTGICTGNPAPSAV

SEQ ID NO: 1415 - protein, 90 aa, Homo sapiens
MKLLMVLMLAALSQHCYAGSGCPLLENVISKTINPQVSKTEYKELLQEFIDDNATTNAIDELKECFLNQTDETLSNVEQLIYDSSLCDLF

SEQ ID NO: 1416 - protein, 93 aa, Homo sapiens
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 1417 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRLGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 1418 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 1419 - protein, 871 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1420 - DNA, 22 bp, Artificial
  Synthetic oligonucleotide
tgatcagcccatctttgatgag

SEQ ID NO: 1421 - protein, 148 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 1422 - protein, 170 aa, Artificial
  Synthetic peptide
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 1423 - protein, 185 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 1424 - protein, 328 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 1425 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 1426 - protein, 461 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 1427 - protein, 214 aa, Homo sapiens
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 1428 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 1429 - protein, 99 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 1430 - protein, 446 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 1431 - protein, 314 aa, Homo sapiens; identical to SEQ ID NO: 1318

SEQ ID NO: 1432 - protein, 517 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 1433 - protein, 493 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 1434 - protein, 258 aa, Homo sapiens; identical to SEQ ID NO: 1334

SEQ ID NO: 1435 - protein, 199 aa, Homo sapiens
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 1436 - protein, 919 aa, Homo sapiens; identical to SEQ ID NO: 1336

SEQ ID NO: 1437 - protein, 931 aa, Homo sapiens
PDVIWGAGCRGLMTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1438 - protein, 957 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1439 - protein, 650 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 1440 - protein, 98 aa, Homo sapiens
AEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 1441 - protein, 99 aa, Homo sapiens
MAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 1442 - protein, 246 aa, Homo sapiens; identical to SEQ ID NO: 1371

SEQ ID NO: 1443 - protein, 862 aa, Homo sapiens
HDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGLTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1444 - protein, 295 aa, Homo sapiens
LRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1445 - protein, 1007 aa, Homo sapiens
MLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSPPSTLLGALHRLSPSTST

SEQ ID NO: 1446 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGYPGPPGPPGEQGLPGAAGKEGAKGDPGPQGISGKDGPAGLRGFPGERGLPGAQGAPGLKGGEGPQGPPGPVGSPGERGSAGTAGPIGLRGRPGPQGPPGPAGEKGAPGEKGPQGPAGRDGVQGPVGLPGPAGPAGSPGEDGDKGEIGEPGQKGSKGGKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGELGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCTSRKGYEKTVIEINTPKIDQVPIVDVMISDFGDQNQKFGFEVGPVCFLG

SEQ ID NO: 1447 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLRGRPGPQGPPGPAGEKGAPGEKGPQGPAGRDGVQGPVGLPGPAGPAGSPGEDGDKGEIGEPGQKGSKGGKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGELGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCTSRKGYEKTVIEINTPKIDQVPIVDVMISDFGDQNQKFGFEVGPVCFLG

SEQ ID NO: 1448 - protein, 153 aa, Homo sapiens
GLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 1449 - protein, 154 aa, Homo sapiens; identical to SEQ ID NO: 1376

SEQ ID NO: 1450 - protein, 99 aa, Homo sapiens; identical to SEQ ID NO: 1377

SEQ ID NO: 1451 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 1452 - protein, 495 aa, Homo sapiens [sequence omitted]

SEQ ID NO: 1453 - protein, 496 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 1454 - protein, 132 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 1455 - protein, 488 aa, Homo sapiens [sequence omitted]

SEQ ID NO: 1456 - protein, 80 aa, Homo sapiens
MAARALCMLGLVLALLSSSSAEEYVGLSANQCAVPAKDRVDCGYPHVTPKECNNRGCCFDSRIPGVPWCFKPLQEAECTF

SEQ ID NO: 1457 - protein, 95 aa, Homo sapiens
MTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 1458 - protein, 302 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 1459 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 1460 - protein, 578 aa, Homo sapiens [sequence omitted]

SEQ ID NO: 1461 - protein, 541 aa, Homo sapiens [sequence omitted]

SEQ ID NO: 1462 - protein, 314 aa, Homo sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 1463 - protein, 357 aa, Homo sapiens
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 1464 - DNA, 516 bp, Homo sapiens
gtgctcacctccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgagcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaaaaaaaaaat

SEQ ID NO: 1465 - DNA, 907 bp, Homo sapiens
gtgctcacctccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatggtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattt

SEQ ID NO: 1466 - DNA, 21 bp, Homo sapiens
tgacactggcaaaacaatgca

SEQ ID NO: 1467 - DNA, 21 bp, Homo sapiens
ggtccttttcaccagcaagct

SEQ ID NO: 1468 - DNA, 94 bp, Artificial; identical to SEQ ID NO: 1297
  Synthetic oligonucleotide

SEQ ID NO: 1469 - DNA, 19 bp, Homo sapiens
tgagagtgattcgcgtggg

SEQ ID NO: 1470 - DNA, 21 bp, Homo sapiens
ccagggtacgaggctttcaat

SEQ ID NO: 1471 - DNA, 91 bp, Artificial; identical to SEQ ID NO: 334
  Synthetic oligonucleotide

SEQ ID NO: 1472 - DNA, 19 bp, Homo sapiens
atttgggtcgcggttcttg

SEQ ID NO: 1473 - DNA, 21 bp, Homo sapiens
tgccttgacattctcgatggt

SEQ ID NO: 1474 - DNA, 133 bp, Artificial; identical to SEQ ID NO: 328
  Synthetic oligonucleotide

SEQ ID NO: 1475 - DNA, 20 bp, Homo sapiens
tgggaacaagagggcatctg

SEQ ID NO: 1476 - DNA, 22 bp, Homo sapiens
ccaccactgcatcaaattcatg

SEQ ID NO: 1477 - DNA, 86 bp, Artificial; identical to SEQ ID NO: 331
  Synthetic oligonucleotide

SEQ ID NO: 1478 - DNA, 19 bp, Artificial
  Synthetic oligonucleotide
agactccaacccacagccc

SEQ ID NO: 1479 - DNA, 19 bp, Artificial
  Synthetic oligonucleotide
cagctcagccaaccttgca

SEQ ID NO: 1480 - DNA, 138 bp, Artificial
  Synthetic oligonucleotide
agactccaacccacagcccagctgtggctgcacagtgagcctgatgggaggtggggaacagggacagggggccacctgggcttcttcacagagaggtcagcaggaaggcttggctacagtgcaaggttggctgagctg

SEQ ID NO: 1481 - DNA, 1491 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1482 - DNA, 1644 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaagtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacagcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1483 - DNA, 1404 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1484 - DNA, 2797 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1485 - DNA, 2962 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1486 - DNA, 2605 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1487 - DNA, 2254 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1488 - DNA, 2611 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1489 - DNA, 2446 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1490 - DNA, 844 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaagggtaagaggggcctaatgggggaagacagtagtcacaccagtaatgcaccccaacactaaacctcacctttttgtccccgctccctcccctagagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1491 - DNA, 752 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1492 - protein, 314 aa, Homo sapiens
MVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 1493 - protein, 285 aa, Homo sapiens
MVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 1494 - protein, 868 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALCFIPVGSAAPQGSP

SEQ ID NO: 1495 - protein, 901 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1496 - protein, 782 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1497 - protein, 665 aa, Homo sapiens
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1498 - protein, 784 aa, Homo sapiens
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1499 - protein, 751 aa, Homo sapiens
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALCFIPVGSAAPQGSP

SEQ ID NO: 1500 - protein, 52 aa, Homo sapiens
MTTRQATKDPLLRGVSPTPSKIPVRSQKRTPFPTVTSCAVDQENQDPRVRGA

SEQ ID NO: 1501 - protein, 126 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTGTCWSHGNTASMAE

SEQ ID NO: 1502 - DNA, 92 bp, Artificial
  Synthetic oligonucleotide
gtaagaggggcctaatgggggaagacagtagtcacaccagtaatgcaccccaacactaaacctcacctttttgtccccgctccctcccctag

SEQ ID NO: 1503 - DNA, 111 bp, Artificial
  Synthetic oligonucleotide
gtacctgttggagccatggtaacacggcctccatggctgagtaggggactaggaagggtaaaagtggggttttggggttttgcactcactcctgctgtctcctacttactg

SEQ ID NO: 1504 - DNA, 204 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacag

SEQ ID NO: 1505 - DNA, 153 bp, Artificial
  Synthetic oligonucleotide
gtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacag

SEQ ID NO: 1506 - DNA, 270 bp, Artificial
  Synthetic oligonucleotide
gtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcag

SEQ ID NO: 1507 - DNA, 165 bp, Artificial
  Synthetic oligonucleotide
gtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccag

SEQ ID NO: 1508 - protein, 90 aa, Artificial
  Synthetic peptide
GKELAGKECEHKRSSPHCELHTCPAPTPGNLMLPHLPPWPSLALPQEEGRGCTSSPVLLIGLAVGGGGGEDSTWWKYRTPDLPLNFPCPS

SEQ ID NO: 1509 - protein, 47 aa, Artificial
  Synthetic peptide
VRLQPTAQLWLHSEPDGRWGTGTGGHLGFFTERSAGRLGYSARLAEL

SEQ ID NO: 1510 - protein, 14 aa, Artificial
  Synthetic peptide
GTCWSHGNTASMAE

SEQ ID NO: 1511 - protein, 4 aa, Artificial
  Synthetic peptide
VRGA

SEQ ID NO: 1512 - DNA, 50 bp, Homo sapiens
catggtaacacggcctccatggctgagtaggggactaggaagggtaaaag

SEQ ID NO: 1513 - DNA, 50 bp, Homo sapiens
tgtacatctagggcctctcagttaggggcttcaatccattcctcatgagg

SEQ ID NO: 1514 - DNA, 50 bp, Homo sapiens
tgtgaacacaagaggtcctcacctcactgtgagctgcacacctgccctgc

SEQ ID NO: 1515 - DNA, 20 bp, Artificial
  Synthetic oligonucleotide
gcgaaacgcgatttgttgtt

SEQ ID NO: 1516 - DNA, 19 bp, Artificial
  Synthetic oligonucleotide
catctggaggagggaggga

SEQ ID NO: 1517 - DNA, 153 bp, Artificial
  Synthetic oligonucleotide
gcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatg

SEQ ID NO: 1518 - DNA, 1172 bp, Artificial
  Synthetic oligonucleotide
ccctggctttcgactagcgtccgctgagctccaggctggtggcgcgtcacttagctggggaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 1519 - DNA, 1489 bp, Artificial
  Synthetic oligonucleotide
ctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatgcctggcttggatggcgttggaacagggcatttggaatgttaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 1520 - DNA, 1183 bp, Artificial
  Synthetic oligonucleotide
ctcccaggcgcgtgctggctgtggtttgctttctcaatgctggtgtcctggggagctgacgtcccccagctcagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 1521 - protein, 52 aa, Homo sapiens
MYLTRERRLEISKTINLTDRQVKIWFQNRRMKLKKMNRENRIRELTSNFNFT

SEQ ID NO: 1522 - protein, 116 aa, Homo sapiens
SQARAGCGLLSQCWCPGELTSPSSEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 1523 - protein, 24 aa, Homo sapiens
SQARAGCGLLSQCWCPGELTSPSS

SEQ ID NO: 1524 - DNA, 63 bp, Artificial
  Synthetic oligonucleotide
ccctggctttcgactagcgtccgctgagctccaggctggtggcgcgtcacttagctggggaag

SEQ ID NO: 1525 - DNA, 74 bp, Artificial
  Synthetic oligonucleotide
ctcccaggcgcgtgctggctgtggtttgctttctcaatgctggtgtcctggggagctgacgtcccccagctcag

SEQ ID NO: 1526 - DNA, 306 bp, Artificial
  Synthetic oligonucleotide
gtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatgcctggcttggatggcgttggaacagggcatttggaatgtt

SEQ ID NO: 1527 - DNA, 19 bp, Artificial
  Synthetic oligonucleotide
ctcgctcccttgctcacac

SEQ ID NO: 1528 - DNA, 20 bp, Artificial
  Synthetic oligonucleotide
aaagggaaagcgggatgttt

SEQ ID NO: 1529 - DNA, 120 bp, Artificial
  Synthetic oligonucleotide
ctcgctcccttgctcacacacacgcacacactcagcctggccgagcaggagccactgaccattttgcaagtgtcaggaccagctacagcgcggtgggcgcaaacatcccgctttcccttt

SEQ ID NO: 1530 - DNA, 19 bp, Artificial
  Synthetic oligonucleotide
acatccccctggaacggat

SEQ ID NO: 1531 - DNA, 24 bp, Artificial
  Synthetic oligonucleotide
cagaaattagcaaagcattgatgg

SEQ ID NO: 1532 - DNA, 91 bp, Artificial
  Synthetic oligonucleotide
acatccccctggaacggatatctgtttggggcactacaatctatcctgtagaactatggccaaatctccatcaatgctttgctaatttctg

SEQ ID NO: 1533 - DNA, 4096 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1534 - DNA, 3081 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1535 - DNA, 3021 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1536 - DNA, 2889 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1537 - DNA, 4406 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaaa

SEQ ID NO: 1538 - DNA, 4214 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaaa

SEQ ID NO: 1539 - DNA, 2775 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1540 - DNA, 2829 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1541 - DNA, 2715 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1542 - protein, 536 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1543 - protein, 387 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1544 - protein, 6 aa, Artificial
  Synthetic peptide
MDQTML

SEQ ID NO: 1545 - protein, 353 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1546 - protein, 323 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1547 - protein, 638 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1548 - protein, 574 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1549 - protein, 285 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1550 - protein, 289 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1551 - protein, 251 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1552 - DNA, 314 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaag

SEQ ID NO: 1553 - DNA, 308 bp, Artificial
  Synthetic oligonucleotide
aaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacag

SEQ ID NO: 1554 - DNA, 140 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcaca

SEQ ID NO: 1555 - DNA, 200 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttgg

SEQ ID NO: 1556 - DNA, 24 bp, Artificial
  Synthetic oligonucleotide
ggttcggatggactacactttgtc

SEQ ID NO: 1557 - DNA, 22 bp, Artificial
  Synthetic oligonucleotide
ccacgtacttctgggtgatgtc

SEQ ID NO: 1558 - DNA, 94 bp, Artificial
  Synthetic oligonucleotide
ggttcggatggactacactttgtccgtacccaccacgtagcagagaaaaccaccttgtatgacatggacattgacatcacccagaagtacgtgg

SEQ ID NO: 1559 - DNA, 4783 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaatttggctcctgctctgcagatgtgtggacgtggccactcccggcagcccaacacacccagcccaggtgaaattgcttcctaagtcttgagatggaattccctgggagagcacctgatgagccagcccattcagctgccacacaaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1560 - DNA, 4656 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1561 - DNA, 4798 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaatttggctcctgctctgcagatgtgtggacgtggccactcccggcagcccaacacacccagcccaggtgaaattgcttcctaagtcttgagatggaattccctgggagagcacctgatgagccagcccattcagctgccacacaaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1562 - DNA, 4671 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1563 - protein, 1044 aa, Homo sapiens
MSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1564 - protein, 1521 aa, Homo sapiens
GVTMAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1565 - protein, 1049 aa, Homo sapiens
MSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1566 - protein, 1526 aa, Homo sapiens
GVTMAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1567 - DNA, 122 bp, Artificial
  Synthetic oligonucleotide
ggttcggatggactacactttgtccgtacccaccacgtagcagagaaaaccaccttgtatgacatggacattgacatcacccagaagtacgtggccgtggcctgccaggaccgcaatgtgag

SEQ ID NO: 1568 - DNA, 15 bp, Artificial
  Synthetic oligonucleotide
agctcttccccgcag

SEQ ID NO: 1569 - protein, 5 aa, Artificial
  Synthetic peptide
ELFPA

SEQ ID NO: 1570 - protein, 891 aa, Homo sapiens
GVTMAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTP

SEQ ID NO: 1571 - protein, 414 aa, Homo sapiens
MSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTP

SEQ ID NO: 1572 - DNA, 28 bp, Artificial
  Synthetic oligonucleotide
actcactcagagactaacacaaaggaag

SEQ ID NO: 1573 - DNA, 26 bp, Artificial
  Synthetic oligonucleotide
agtatgggaagaatttactggtcaca

SEQ ID NO: 1574 - DNA, 106 bp, Artificial
  Synthetic oligonucleotide
actcactcagagactaacacaaaggaagtaatttcttacctggtcattatttagtctacaataagttcatccttcttcagtgtgaccagtaaattcttcccatact

SEQ ID NO: 1575 - DNA, 3483 bp, Artificial
  Synthetic oligonucleotide
ggccattccaatggaacagacagggtaaggaccaatctggactgtgttatcttttccaggtgcaagtatgtgctatggaactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 1576 - DNA, 3344 bp, Artificial
  Synthetic oligonucleotide
ggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 1577 - DNA, 1247 bp, Artificial
  Synthetic oligonucleotide
agcaacacattcaggcaaagggatgcgagaagaactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatgtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacattccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagaga

SEQ ID NO: 1578 - DNA, 5710 bp, Artificial
  Synthetic oligonucleotide
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 1579 - DNA, 5663 bp, Artificial
  Synthetic oligonucleotide
cgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 1580 - protein, 630 aa, Homo sapiens
MCYGTPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1581 - protein, 4 aa, Homo sapiens
MCYG

SEQ ID NO: 1582 - protein, 546 aa, Homo sapiens
MSHCCRKSSPKCHLPLALDLSHHRVPLYRVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1583 - protein, 29 aa, Homo sapiens
MSHCCRKSSPKCHLPLALDLSHHRVPLYR

SEQ ID NO: 1584 - protein, 139 aa, Homo sapiens
SNTFRQRDARRTPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSMFRTNKKAKIWRDTFLVERG

SEQ ID NO: 1585 - protein, 11 aa, Homo sapiens
SNTFRQRDARR

SEQ ID NO: 1586 - protein, 871 aa, Homo sapiens; identical to SEQ ID NO: 1419

SEQ ID NO: 1587 - DNA, 162 bp, Artificial; identical to SEQ ID NO: 281
  Synthetic oligonucleotide

SEQ ID NO: 1588 - DNA, 78 bp, Artificial
  Synthetic oligonucleotide
ggccattccaatggaacagacagggtaaggaccaatctggactgtgttatcttttccaggtgcaagtatgtgctatgg

SEQ ID NO: 1589 - DNA, 32 bp, Artificial
  Synthetic oligonucleotide
agcaacacattcaggcaaagggatgcgagaag

SEQ ID NO: 1590 - DNA, 266 bp, Artificial
  Synthetic oligonucleotide
ggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacag

SEQ ID NO: 1591 - DNA, 831 bp, Artificial
  Synthetic oligonucleotide
gtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacattccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagaga

SEQ ID NO: 1592 - DNA, 14 bp, Artificial
  Synthetic oligonucleotide
ggcggcggcaggat

SEQ ID NO: 1593 - DNA, 15 bp, Artificial
  Synthetic oligonucleotide
gtcgggagcgcaggg

SEQ ID NO: 1594 - DNA, 129 bp, Artificial
  Synthetic oligonucleotide
ggcggcggcaggatcggccagaggaggagggaagcgctttttttgatcctgattccagtttgcctctctctttttttcccccaaattattcttcgcctgattttcctcgcggagccctgcgctcccgac

SEQ ID NO: 1595 - DNA, 2533 bp, Artificial
  Synthetic oligonucleotide
cccgtcacatgcgatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaatcttga

SEQ ID NO: 1596 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 1597 - DNA, 161 bp, Artificial
  Synthetic oligonucleotide
tcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccc

SEQ ID NO: 1598 - DNA, 21 bp, Artificial
  Synthetic oligonucleotide
ccccagactctgtgcacttca

SEQ ID NO: 1599 - DNA, 24 bp, Artificial
  Synthetic oligonucleotide
tgggctctgctctgtcttagtgta

SEQ ID NO: 1600 - DNA, 110 bp, Artificial
  Synthetic oligonucleotide
ccccagactctgtgcacttcagaccagcagcagcaggagggctcccgagggccttatgagaaaacctgtgtggacatcccttggtgtacactaagacagagcagagccca

SEQ ID NO: 1601 - DNA, 5390 bp, Artificial
  Synthetic oligonucleotide
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 1602 - DNA, 5453 bp, Artificial
  Synthetic oligonucleotide
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 1603 - DNA, 4543 bp, Artificial
  Synthetic oligonucleotide
ttccattttcctaataccagacacaaacaagagagatggcaaggatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 1604 - protein, 726 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 1605 - protein, 747 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 1606 - protein, 516 aa, Homo sapiens
MARICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 1607 - DNA, 43 bp, Artificial
  Synthetic oligonucleotide
ttccattttcctaataccagacacaaacaagagagatggcaag

SEQ ID NO: 1608 - DNA, 1199 bp, Artificial
  Synthetic oligonucleotide
ctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctac

SEQ ID NO: 1609 - DNA, 2871 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1610 - DNA, 2514 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1611 - DNA, 2706 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1612 - protein, 87 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLRLQGP

SEQ ID NO: 1613 - protein, 5 aa, Homo sapiens
RLQGP

SEQ ID NO: 1614 - DNA, 23 bp, Artificial
  Synthetic oligonucleotide
ttttcaaatgggtagggaccatc

SEQ ID NO: 1615 - DNA, 21 bp, Artificial
  Synthetic oligonucleotide
tgagtttctctgggacccgga

SEQ ID NO: 1616 - DNA, 103 bp, Artificial
  Synthetic oligonucleotide
ttttcaaatgggtagggaccatccatggagcagctggaacagcagtggggagcatcagaaccagctcaacagtttgtctactgtccggtcccagagaaactca

SEQ ID NO: 1617 - DNA, 22 bp, Artificial
  Synthetic oligonucleotide
tgtttctccaaatgccagaacc

SEQ ID NO: 1618 - DNA, 19 bp, Artificial
  Synthetic oligonucleotide
ggctggtgacctgctttga

SEQ ID NO: 1619 - DNA, 126 bp, Artificial
  Synthetic oligonucleotide
tgtttctccaaatgccagaacccaacattgatagtcccttgaacacacatgctgccgagctctggaaaaaccccacagcttttaagaagtacctgcaagaaacctactcaaagcaggtcaccagcc

SEQ ID NO: 1620 - DNA, 19 bp, Artificial
  Synthetic oligonucleotide
gaggcgaggagtgtggcac

SEQ ID NO: 1621 - DNA, 17 bp, Artificial
  Synthetic oligonucleotide
gctgcgatgggcacgtt

SEQ ID NO: 1622 - DNA, 130 bp, Artificial
  Synthetic oligonucleotide
gaggcgaggagtgtggcactttggcggggaaggggcggctcagccctcgggccctcgcccgccctctccgggtctggagcgtctcctcgcgccatccctgcaccgccagggggaacgtgcccatcgcagc

SEQ ID NO: 1623 - DNA, 20 bp, Artificial
  Synthetic oligonucleotide
cctagcagctcgtctccagc

SEQ ID NO: 1624 - DNA, 18 bp, Artificial
  Synthetic oligonucleotide
ggtgtcctcgccgaacct

SEQ ID NO: 1625 - DNA, 120 bp, Artificial
  Synthetic oligonucleotide
cctagcagctcgtctccagctaaaaatcctccagagccaccggcgaacactgctaggcacagcctggtgccaagctacgaagcgcccgccgccgccgtgcgcaggttcggcgaggacacc

SEQ ID NO: 1626 - DNA, 1582 bp, Homo sapiens
tttttgtttgtgtacttaataaagggtaaatatgtcatgtttgtttggaacagtcatggttaatatctatgttgtcccagtatatctattaatagaactctctttcactctcaacagcgtcctagtccggatgacaaattatatggttatctctcagtaaagggtctttttttaaaatgatttttttttcagggggtagggtaggcaggaagcttaaactgggtaatttagttgtagaagagtgccctgtggcaaataattgattattcatttccagcatccccttttcttctccttgacagttattaaaaaaaaaaaagttaccagcttatgtcattttaaagaacactcgccctgaaaacttctgagaggttggccatttgaaaccctggttttagtgtctgtattattagtgaactaccgtgttcccatgtggctacacaaccacaattatgtactatctggctctttaccaaagtttgcagacctctaatctagagtgcgacatttcccctcattaactcttaggtcccttggctctaaaagggtatattcatcttggccctatacagggaaagggggaatgggattaatgatgtgctttgtaagaagaaccaattttaattttcacaaaggcttgacgtagctgtgagagaaagggtaagaagaagcaggcttcttcttagaagtctgagatggcctaaagtggtgggggaagaagggagagtggggagaaagagaaacaagaaaagctgagagtgaattccccagagaggtagccactgattctgccctactctttgctggaattctggaaaacacctgggcttctaaaagatagggagctcatgcatcatggtagggccacagctcaggctagggccagagatagctcagagtagcgccacggctcagggtaggtccacagtgcagggtagggccatagctcagagtagggccatagctcataaccacagctcagggtaggacctgctgatctatttggggacccccagcagagcctgtctaattgcatatcttgaaaaggattggaaaactgtcataatgacattattccctctcactttccttgtccaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttacagtg

SEQ ID NO: 1627 - protein, 64 aa, Homo sapiens
MRIAVICFCLLGITCAIPVKQADSGSSEEKQLYNKYPDAVATWLNPDPSQKQNLLAPQVFLNFS

SEQ ID NO: 1628 - protein, 32 aa, Homo sapiens
MRIAVICFCLLGITCAIPVKQADSGSSEEKQH

SEQ ID NO: 1629 - protein, 39 aa, Homo sapiens
MRIAVICFCLLGITCAIPVKQADSGSSEEKQVSIFYVFI

SEQ ID NO: 1630 - DNA, 101 bp, Artificial
  Synthetic oligonucleotide
tggcaagaagaaggtctggttagaccccaatgagaccaatgaaatcgccaatgccaactcccgtcagcagatccggaagctcatcaaagatgggctgatca

SEQ ID NO: 1631 - DNA, 20 bp, Artificial
  Synthetic oligonucleotide
cggtttgctgcggtaatcat

SEQ ID NO: 1632 - DNA, 21 bp, Artificial
  Synthetic oligonucleotide
tttcttgctgccagtctggac

SEQ ID NO: 1633 - DNA, 122 bp, Artificial
  Synthetic oligonucleotide
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 1634 - DNA, 26 bp, Homo sapiens
gaaggctcttgtcacttactagccat

SEQ ID NO: 1635 - DNA, 24 bp, Homo sapiens
tgtcaccatatttaatcctcccaa

SEQ ID NO: 1636 - DNA, 101 bp, Homo sapiens
gaaggctcttgtcacttactagccatgtgattttggaaagaaacttaacattaattccttcagctacaatggaattcttgggaggattaaatatggtgaca

SEQ ID NO: 1637 - DNA, 21 bp, Homo sapiens
ggcgtctttctccctctgaac

SEQ ID NO: 1638 - DNA, 20 bp, Homo sapiens
gtcccattctgggtgctgtg

SEQ ID NO: 1639 - DNA, 114 bp, Homo sapiens
ggcgtctttctccctctgaacctcagtttccacctgtgtcgagtgtgggtgagacccctcgcggggagctatgcaggttacggagaaaaggcagcacagcacccagaatgggac

SEQ ID NO: 1640 - DNA, 20 bp, Artificial
  Synthetic oligonucleotide
ggacggatacagcaggaacg

SEQ ID NO: 1641 - DNA, 23 bp, Artificial
  Synthetic oligonucleotide
tattttccaaaaaaggccagctc

SEQ ID NO: 1642 - DNA, 95 bp, Artificial
  Synthetic oligonucleotide
ggacggatacagcaggaacgaaaaaacatccgacccaacattattcttgtgcttaccgatgatcaagatgtggagctggccttttttggaaaata

SEQ ID NO: 1643 - DNA, 23 bp, Artificial
  Synthetic oligonucleotide
gttgcatttctcagtgctggttt

SEQ ID NO: 1644 - DNA, 16 bp, Artificial
  Synthetic oligonucleotide
agggtgccgggtgagg

SEQ ID NO: 1645 - DNA, 106 bp, Artificial
  Synthetic oligonucleotide
gttgcatttctcagtgctggtttctaatcagaccagtggattgagtttctctaccatcctccccacgttcttctctaagctgcctccaagcctcacccggcaccct

SEQ ID NO: 1646 - DNA, 18 bp, Homo sapiens
accagccacctcaaccca

SEQ ID NO: 1647 - DNA, 22 bp, Homo sapiens
ctggagcagagagtctttgcct

SEQ ID NO: 1648 - DNA, 110 bp, Homo sapiens
accagccacctcaacccaaggccctgggcaatcagcagccttcgtgggattcagaggatagcagcaacttcaaagatgtaggttcaaaaggcaaagactctctgctccag

SEQ ID NO: 1649 - DNA, 25 bp, Artificial
  Synthetic oligonucleotide
gaaggcacaggaaaaacagatattg

SEQ ID NO: 1650 - DNA, 21 bp, Artificial
  Synthetic oligonucleotide
tggtgctcttggtcacaggat

SEQ ID NO: 1651 - DNA, 119 bp, Artificial
  Synthetic oligonucleotide
gaaggcacaggaaaaacagatattgcatcacgttaccctaccctttggactgaacaggttaaaagtcggcagaacaaaaccaataagaattcagtgtcatcctgtgaccaagagcacca

SEQ ID NO: 1652 - DNA, 21 bp, Artificial
  Synthetic oligonucleotide
ccctgtgccttatttgaccct

SEQ ID NO: 1653 - DNA, 19 bp, Artificial
  Synthetic oligonucleotide
gctgggtagactgggtgca

SEQ ID NO: 1654 - DNA, 101 bp, Artificial
  Synthetic oligonucleotide
cctgtgccttatttgaccctcatgccaaccccgggaggtggagactgttgccccactctgcagatgcagaaacggaggcttggctgctgccagggggagga

SEQ ID NO: 1655 - DNA, 20 bp, Artificial
  Synthetic oligonucleotide
gctgattgtccccatgaagg

SEQ ID NO: 1656 - DNA, 20 bp, Artificial
  Synthetic oligonucleotide
tggcatacgggaactcagtg

SEQ ID NO: 1657 - DNA, 101 bp, Artificial
  Synthetic oligonucleotide
gctgattgtccccatgaaggccagccttgaagcttggtcagtctccctaactgtatgattgatccccacttattgcactacatcactgagttcccgtatgc

SEQ ID NO: 1658 - DNA, 24 bp, Artificial
  Synthetic oligonucleotide
attgaataattcagcacctgaggc

SEQ ID NO: 1659 - DNA, 22 bp, Artificial
  Synthetic oligonucleotide
ttcatatggctactccccacct

SEQ ID NO: 1660 - DNA, 104 bp, Artificial
  Synthetic oligonucleotide
attgaataattcagcacctgaggctggtggatgattctttgcaatttggcaggaatgggagagtcgggagcagtagttggcaaggtggggagtagccatatgaa

SEQ ID NO: 1661 - DNA, 27 bp, Artificial
  Synthetic oligonucleotide
ttctcatagtattccattgattgggta

SEQ ID NO: 1662 - DNA, 21 bp, Artificial
  Synthetic oligonucleotide
caccggtatggagaatagcga

SEQ ID NO: 1663 - DNA, 107 bp, Artificial
  Synthetic oligonucleotide
ttctcatagtattccattgattgggtataccaggttctgtttacttttacttggcagttgatagaataggtgtagtttatactttttcgctattctccataccggtg

SEQ ID NO: 1664 - DNA, 21 bp, Artificial
  Synthetic oligonucleotide
accccaaacccaacttgattc

SEQ ID NO: 1665 - DNA, 21 bp, Artificial
  Synthetic oligonucleotide
tcagtggtggagccaagtctc

SEQ ID NO: 1666 - DNA, 101 bp, Artificial
  Synthetic oligonucleotide
accccaaacccaacttgattcctgccatatggaggaggctctggagtcctgctctgtgtggtccaggtcctttccaccctgagacttggctccaccactga

SEQ ID NO: 1667 - DNA, 22 bp, Artificial
  Synthetic oligonucleotide
ctcctgaaccctactccaagca

SEQ ID NO: 1668 - DNA, 21 bp, Artificial
  Synthetic oligonucleotide
caggcgatcctatggaaatcc

SEQ ID NO: 1669 - DNA, 101 bp, Artificial
  Synthetic oligonucleotide
ctcctgaaccctactccaagcacagcctctgtctgactcccttgtccttcaagagaactgttctccaggtctcagggccaggatttccataggatcgcctg

SEQ ID NO: 1670 - DNA, 20 bp, Artificial
  Synthetic oligonucleotide
caagcaattgagggaccagg

SEQ ID NO: 1671 - DNA, 29 bp, Artificial
  Synthetic oligonucleotide
caaaaaacattgttaatgagagagatgac

SEQ ID NO: 1672 - DNA, 113 bp, Artificial
  Synthetic oligonucleotide
caagcaattgagggaccaggaagtggatcctctagagatgaggaggcattctgctggatgacttttaaaaatgttttctccagagtcatctctctcattaacaatgttttttg

SEQ ID NO: 1673 - DNA, 22 bp, Artificial
  Synthetic oligonucleotide
atttccatcctcaactggcaga

SEQ ID NO: 1674 - DNA, 16 bp, Artificial
  Synthetic oligonucleotide
tgccctggaacccacg

SEQ ID NO: 1675 - DNA, 104 bp, Artificial
  Synthetic oligonucleotide
atttccatcctcaactggcagagatgagagcctggagcattgcagatgccagggacttcacaaatgaaggcacagcatgggaaacctgcgtgggttccagggca

SEQ ID NO: 1676 - DNA, 20 bp, Artificial
  Synthetic oligonucleotide
tctgctggccactgtgactg

SEQ ID NO: 1677 - DNA, 21 bp, Artificial
  Synthetic oligonucleotide
gaagaaaaagagctcgcctcg

SEQ ID NO: 1678 - DNA, 136 bp, Artificial
  Synthetic oligonucleotide
tctgctggccactgtgactgcagcatatgccctcagcatgtgtccctctctcccaccccagccagacgccccgccagatgcctgtgaggcctcctttgacgcggtctccaccatccgaggcgagctctttttcttc

SEQ ID NO: 1679 - DNA, 25 bp, Artificial
  Synthetic oligonucleotide
acatttggttcttccaagggactac

SEQ ID NO: 1680 - DNA, 19 bp, Artificial
  Synthetic oligonucleotide
tcgatctcagagggcaccc

SEQ ID NO: 1681 - DNA, 111 bp, Artificial
  Synthetic oligonucleotide
acatttggttcttccaagggactactggcgtttccaccccagcacccggcgtgtagacagtcccgtgccccgcagggccactgactggagaggggtgccctctgagatcga

SEQ ID NO: 1682 - DNA, 26 bp, Homo sapiens
acactaaaagaacaaacaccttgctc

SEQ ID NO: 1683 - DNA, 22 bp, Homo sapiens
tcctcagaaggcacatgaaaga

SEQ ID NO: 1684 - DNA, 106 bp, Artificial
  Synthetic oligonucleotide
acactaaaagaacaaacaccttgctcttcgagatgagacattttgccaagcagttgaccacttagttctcaagaagcaactatctctttcatgtgccttctgagga

SEQ ID NO: 1685 - DNA, 20 bp, Homo sapiens
agtgatggagcaaagtgccg

SEQ ID NO: 1686 - DNA, 21 bp, Homo sapiens
cagcagctgatgcaaactgag

SEQ ID NO: 1687 - DNA, 132 bp, Artificial
  Synthetic oligonucleotide
agtgatggagcaaagtgccgggatcatgtaccgcaagtcctgtgcatcatcagcggcctgtctcatcgcctctgccgggtaccagtccttctgctccccagggaaactgaactcagtttgcatcagctgctg

SEQ ID NO: 1688 - DNA, 21 bp, Artificial
  Synthetic oligonucleotide
gtccttccagtgcaagaccca

SEQ ID NO: 1689 - DNA, 16 bp, Artificial
  Synthetic oligonucleotide
tgggcctggcaaagcc

SEQ ID NO: 1690 - DNA, 149 bp, Artificial
  Synthetic oligonucleotide
gtccttccagtgcaagacccaaaaccgccagggccacctgtggcctcctcgtcctcggccactagcctgccgtggcccgtggtcatcggcatcccagccggcgctgtcttcatcctgggcaccctgctcctgtggctttgccaggccca

SEQ ID NO: 1691 - DNA, 19 bp, Artificial
  Synthetic oligonucleotide
ccgacggctcctacctcaa

SEQ ID NO: 1692 - DNA, 21 bp, Artificial
  Synthetic oligonucleotide
ggaagctgtagcccatggtgt

SEQ ID NO: 1693 - DNA, 102 bp, Artificial
  Synthetic oligonucleotide
ccgacggctcctacctcaataagctgctcatcacccgtgcccgccaggacgatgcgggcatgtacatctgccttggcgccaacaccatgggctacagcttcc

SEQ ID NO: 1694 - protein, 1189 aa, Homo sapiens
EGLGEQASWAMVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 1695 - protein, 717 aa, Homo sapiens [sequence omitted]

SEQ ID NO: 1696 - protein, 478 aa, Homo sapiens; identical to SEQ ID NO: 1418

SEQ ID NO: 1697 - protein, 871 aa, Homo sapiens [sequence omitted]

SEQ ID NO: 1698 - protein, 40 aa, Homo sapiens
LRSCQGYKQCNPRPKNLDVGNKDGGSYDLHRGQLWDGWEG

SEQ ID NO: 1699 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 1700 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPQGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 1701 - protein, 295 aa, Homo sapiens
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 1702 - protein, 18 aa, Artificial
  Synthetic peptide
AFCQLIYPGKGRTRARMF

SEQ ID NO: 1703 - protein, 396 aa, Homo sapiens
MQLKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 1704 - protein, 216 aa, Homo sapiens
MRPRSGPTRNPRLRAFAGVPTRGRTRGQSRRCAAEASAGPERDARPGAPAAGTMGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVKWSRSCCRETLTSRRSPLAPSPTGP

SEQ ID NO: 1705 - protein, 275 aa, Homo sapiens
MRILQLILLALATGLVGGETRIIKGFECKPHSQPWQAALFEKTRLLCGATLIAPRWLLTAAHCLKPWVSLTSPTHVSPDLSSSNYCLSHLSRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 1706 - protein, 111 aa, Homo sapiens [sequence omitted]

SEQ ID NO: 1707 - protein, 112 aa, Homo sapiens; identical to SEQ ID NO: 1409

SEQ ID NO: 1708 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 1709 - protein, 165 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLASSRHTAELKEMPPPPALFFQPSPPTPHLPE

SEQ ID NO: 1710 - protein, 164 aa, Homo sapiens [sequence omitted]

SEQ ID NO: 1711 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 1712 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 1713 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 1714 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 1715 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 1716 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 1717 - protein, 33 aa, Artificial
  Synthetic peptide
NSPTPRLLPNMGGAPGRCPRPSLGAWRGASCWC

SEQ ID NO: 1718 - protein, 15 aa, Artificial
  Synthetic peptide
ECLTVNPSLQIPLNP

SEQ ID NO: 1719 - protein, 18 aa, Artificial
  Synthetic peptide
ECVCSKGFPFPLIGDSEG

SEQ ID NO: 1720 - protein, 49 aa, Artificial
  Synthetic peptide
VRGGTAGYLGEETRGQRPGCDSQSHTGPSKKPSAPSPLPAGTSWDRGVP

SEQ ID NO: 1721 - protein, 17 aa, Artificial
  Synthetic peptide
RECLLPWLPLQISEGRS

SEQ ID NO: 1722 - protein, 139 aa, Artificial
  Synthetic peptide
LTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 1723 - protein, 57 aa, Artificial
  Synthetic peptide
PQNPNSQPRAAGSLEVIISHPFVRRLEILISPFQFQNSIPKNSQIVPAASPRGTSSP

SEQ ID NO: 1724 - protein, 51 aa, Artificial
  Synthetic peptide
PELRQPARLGLPECWDYRHEPRCPAQMGSHFIVQAGLKLLASSKPPKCWDY

SEQ ID NO: 1725 - protein, 5 aa, Artificial
  Synthetic peptide
VRKSW

SEQ ID NO: 1726 - protein, 6 aa, Artificial
  Synthetic peptide
MATYIH

SEQ ID NO: 1727 - protein, 19 aa, Artificial
  Synthetic peptide
MTQNFRLMWNILLFPLNFS

SEQ ID NO: 1728 - protein, 60 aa, Artificial
  Synthetic peptide
VKNAIYFFFHKVLLLLFVVDVCSRNLIGIEAFHNYRIMWKFLGRCPFTASYKLIITEFRK

SEQ ID NO: 1729 - protein, 19 aa, Artificial
  Synthetic peptide
MTQNFRLMWNILLFPLNFS

SEQ ID NO: 1730 - protein, 28 aa, Artificial
  Synthetic peptide
VSSLCLNGTEKKIKDGREESFSVEISLA

SEQ ID NO: 1731 - protein, 13 aa, Artificial
  Synthetic peptide
DFLAAHVFGKLLE

SEQ ID NO: 1732 - protein, 30 aa, Artificial
  Synthetic peptide
MPASARLAGAGLLLAFLRALGCAGRAPGLS

SEQ ID NO: 1733 - protein, 1120 aa, Artificial
  Synthetic peptide
LDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1734 - protein, 443 aa, Artificial
  Synthetic peptide
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRV

SEQ ID NO: 1735 - protein, 55 aa, Artificial
  Synthetic peptide
MGLSDGEWQLVLNVWGKVEADIPGHGQEVLIRLFKGHPETLEKFDKFKHLKSEDE

SEQ ID NO: 1736 - protein, 55 aa, Artificial; identical to SEQ ID NO: 1735
  Synthetic peptide

SEQ ID NO: 1737 - protein, 111 aa, Artificial
  Synthetic peptide
RGAGEREAGQQSAPVTPCALPGVPGQRVRRGFAVPLIQEGAHGDGAALRRAAGACLLPLHLQGLHGRVRAYEAGGGSRAMARPSSPDGPPPPPHLTWPCAGAGSAAAMWRW

SEQ ID NO: 1738 - protein, 26 aa, Artificial
  Synthetic peptide
VRTRRVGARGPWPGPPRPMGHPLLRT

SEQ ID NO: 1739 - protein, 125 aa, Artificial
  Synthetic peptide
RGAGEREAGQQSAPVTPCALPGVPGQRVRRGFAVPLIQEGAHGDGAALRRAAGACLLPLHLQGLHGRVRVPRRLCGGGEHGRCSAAADAEADECAAVPAGARTGPAGPGGQPARAHRPLLCAVPG

SEQ ID NO: 1740 - protein, 61 aa, Artificial
  Synthetic peptide
SPGRLWSPLYLLLMPGGVGWGGCWAPASLQVPNKAVWQSDSKKEALAAAWPAPTCLPFLQA

SEQ ID NO: 1741 - protein, 110 aa, Artificial
  Synthetic peptide
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVR

SEQ ID NO: 1742 - protein, 139 aa, Artificial
  Synthetic peptide
SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1743 - protein, 29 aa, Artificial
  Synthetic peptide
SHCVTRLECSGTISAHCNLCLPGSNDHPT

SEQ ID NO: 1744 - protein, 5 aa, Artificial
  Synthetic peptide
MWVLG

SEQ ID NO: 1745 - protein, 21 aa, Artificial
  Synthetic peptide
DTKRTNTLLFEMRHFAKQLTT

SEQ ID NO: 1746 - protein, 27 aa, Artificial
  Synthetic peptide
DRVSLCHEAGVQWNNFSTLQPLPPRLK

SEQ ID NO: 1747 - protein, 5 aa, Artificial
  Synthetic peptide
MWVLG

SEQ ID NO: 1748 - protein, 8 aa, Artificial
  Synthetic peptide
GNPAPSAV

SEQ ID NO: 1749 - protein, 81 aa, Artificial
  Synthetic peptide
CEYICSSLAQAASPNPQGQRQDFSVPLRFKYTDPQPWTSRLSVTFCPRKTWADQVLTKNRRGGAASVLGGSGSTPYDGRNR

SEQ ID NO: 1750 - protein, 44 aa, Artificial
  Synthetic peptide
GKWLPGASASYSGVESIWFSPKSQEDIFFPSLCSMGTRKSQILS

SEQ ID NO: 1751 - protein, 23 aa, Artificial
  Synthetic peptide
DAMVVSSRPKATTHRKSRTLSRR

SEQ ID NO: 1752 - protein, 6 aa, Artificial
  Synthetic peptide
RSKRNL

SEQ ID NO: 1753 - protein, 13 aa, Artificial
  Synthetic peptide
LLWLRGKVSFYCF

SEQ ID NO: 1754 - protein, 69 aa, Artificial
  Synthetic peptide
DCGFPAFRELKRAETVSPVFFTRRCIWEDLKSTGFSPAGGGRPPGGGPRTQEDSGLPCWRSSCSVTLQV

SEQ ID NO: 1755 - protein, 20 aa, Artificial
  Synthetic peptide
VPIGWVLSPSPTSLRAPLPG

SEQ ID NO: 1756 - protein, 31 aa, Artificial
  Synthetic peptide
ERQDLTMLSRLVLNSWPQMILPPQPPKVLEL

SEQ ID NO: 1757 - protein, 7 aa, Artificial
  Synthetic peptide
TQGVVGD

SEQ ID NO: 1758 - protein, 15 aa, Artificial
  Synthetic peptide
VPGAVGQGRKHLGRV

SEQ ID NO: 1759 - protein, 29 aa, Artificial
  Synthetic peptide
PHKYSAHGRTRHFESATRTTNGAQKLSRI

SEQ ID NO: 1760 - protein, 751 aa, Artificial
  Synthetic peptide
MKYSCCALVLAVLGTELLGSLCSTVRSPRFRGRIQQERKNIRPNIILVLTDDQDVELAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLME

SEQ ID NO: 1761 - protein, 13 aa, Artificial
  Synthetic peptide
CVIVPPLSQPQIH

SEQ ID NO: 1762 - protein, 22 aa, Artificial
  Synthetic peptide
ARYDGDQPRCAPRPRGLSPTVF

SEQ ID NO: 1763 - protein, 8 aa, Artificial
  Synthetic peptide
GLLHRLNH

SEQ ID NO: 1764 - protein, 15 aa, Artificial
  Synthetic peptide
DSLLQVLNVKEGTPS

SEQ ID NO: 1765 - protein, 13 aa, Artificial
  Synthetic peptide
GKPSLLLPHSLLG

SEQ ID NO: 1766 - protein, 57 aa, Artificial
  Synthetic peptide
MGRVRTLAGECSAQAQAQSLLAVVLSAPPSGGTPSARLSVRSPSPRDPWGLWAPVLQ

SEQ ID NO: 1767 - protein, 57 aa, Artificial; identical to SEQ ID NO: 1766
  Synthetic peptide

SEQ ID NO: 1768 - protein, 29 aa, Artificial
  Synthetic peptide
MKSLTATSSMKVLLPRTFWTRKLMKFLLL

SEQ ID NO: 1769 - protein, 44 aa, Artificial
  Synthetic peptide
MAEKALLCPSSAGLGTWPWVLNSAWPVLPLAVDQGVDWRPRGPV

SEQ ID NO: 1770 - protein, 76 aa, Artificial
  Synthetic peptide
VEELLSGNPHIEKESARSIADGAMMEAASVCMGQMEPDQVYEGITFEDFLKIWQGIDIETKMHVRFLNMETMALCH

SEQ ID NO: 1771 - protein, 14 aa, Artificial
  Synthetic peptide
TPASHLAMRQHHHH

SEQ ID NO: 1772 - protein, 28 aa, Artificial
  Synthetic peptide
YAPPLLTFLPTRPSCGSQDGKGPPHQVI

SEQ ID NO: 1773 - protein, 31 aa, Artificial
  Synthetic peptide
ARWLTPVIPALWEAETGGSRGQEMETIPANT

SEQ ID NO: 1774 - protein, 14 aa, Artificial
  Synthetic peptide
WKVHLPKGEGFSSG

SEQ ID NO: 1775 - protein, 80 aa, Artificial
  Synthetic peptide
GARLPRHATPCWCPDPPPGPGVPPTGWGPTLPSRAVLARSSAEGGQPRGTVSTAPGMGLGCSPGLCVGVPLPTSFPLALA

SEQ ID NO: 1776 - protein, 221 aa, Artificial
  Synthetic peptide
TQNRQGHLWPPRPRPLACRGPWSSASQPALSSSWAPCSCGFARPRRSRAPPRLPLPCLGTARRGRPATAAETRTFPRWPPSALALVWGCVRSMGLRQPPSTYWAQAQLLALSCTPNSTQTSTHTHTHTLTHTHTWRARSTSTSTISARRHRICSGHGGAGQTGRLGGWRTELQTKAGDPWRGGMASTPGSLCVRHSPWTHTHRHTHYLDACMHTHARTRAP

SEQ ID NO: 1777 - DNA, 20 bp, Homo sapiens
tgctgtcgcctcctctgatg

SEQ ID NO: 1778 - DNA, 20 bp, Homo sapiens
cctcagaaggcacatgaaag

SEQ ID NO: 1779 - DNA, 31 bp, Homo sapiens
atagctagcatgtgggtcctaggcatcgcgg

SEQ ID NO: 1780 - DNA, 30 bp, Homo sapiens
cccaagcttctaagtggtcaactgcttggc

What is claimed is:

1. An isolated polypeptide having the sequence of SEQ ID NO:1398 (HSSTROL3 P9).

2. An isolated polypeptide having the sequence of SEQ ID NO: 253.

3. A biomarker capable of detecting lung cancer, comprising the amino acid sequence of SEQ ID NO:1398 (HSSTROL3 P9) according to claim 1 marked with a label.

* * * * *

UNITED STATES PATENT AND TRADEMARK OFFICE
CERTIFICATE OF CORRECTION

| | | |
|---|---|---|
| PATENT NO. | : 7,569,662 B2 | Page 1 of 1 |
| APPLICATION NO. | : 11/051720 | |
| DATED | : August 4, 2009 | |
| INVENTOR(S) | : Pollock et al. | |

It is certified that error appears in the above-identified patent and that said Letters Patent is hereby corrected as shown below:

On the cover page,

[*] Notice: Subject to any disclaimer, the term of this patent is extended or adjusted under 35 U.S.C. 154(b) by 268 days.

Delete the phrase "by 268 days" and insert -- by 695 days --

Signed and Sealed this

Fourth Day of May, 2010

David J. Kappos
*Director of the United States Patent and Trademark Office*